United States Patent 11,396,665 (CRISPR-CAS SYSTEM FOR A FILAMENTOUS FUNGAL HOST CELL) - sequence listing, part 59

SEQ ID NO: 7 - DNA, 38042092 bp, Mortierella alpina ATCC 32222 (residues 25,361,401-27,474,850 of 38,042,092)
  misc_feature (16413)..(16413): n is a, c, g, or t
  misc_feature (94211)..(94211): n is a, c, g, or t
  misc_feature (107854)..(107854): n is a, c, g, or t
  misc_feature (117095)..(117095): n is a, c, g, or t
  misc_feature (155256)..(155256): n is a, c, g, or t
  misc_feature (239300)..(239300): n is a, c, g, or t
  misc_feature (245980)..(245980): n is a, c, g, or t
  misc_feature (313610)..(313610): n is a, c, g, or t
  misc_feature (359832)..(359832): n is a, c, g, or t
  misc_feature (751867)..(751867): n is a, c, g, or t
  misc_feature (768867)..(768867): n is a, c, g, or t
  misc_feature (846931)..(846931): n is a, c, g, or t
  misc_feature (863626)..(863626): n is a, c, g, or t
  misc_feature (1097056)..(1097056): n is a, c, g, or t
  misc_feature (1299567)..(1299567): n is a, c, g, or t
  misc_feature (1690471)..(1690471): n is a, c, g, or t
  misc_feature (1766977)..(1766977): n is a, c, g, or t
  misc_feature (1785290)..(1785290): n is a, c, g, or t
  misc_feature (1785296)..(1785296): n is a, c, g, or t
  misc_feature (1996018)..(1996018): n is a, c, g, or t
  misc_feature (2883286)..(2883286): n is a, c, g, or t
  misc_feature (3234950)..(3234950): n is a, c, g, or t
  misc_feature (3394760)..(3394760): n is a, c, g, or t
  misc_feature (3508823)..(3508823): n is a, c, g, or t
  misc_feature (3508830)..(3508830): n is a, c, g, or t
  misc_feature (4305290)..(4305290): n is a, c, g, or t
  misc_feature (6639811)..(6639811): n is a, c, g, or t
  misc_feature (9464202)..(9464202): n is a, c, g, or t
  misc_feature (10102176)..(10102176): n is a, c, g, or t
  misc_feature (10393520)..(10393520): n is a, c, g, or t
  misc_feature (10406905)..(10406905): n is a, c, g, or t
  misc_feature (10406909)..(10406909): n is a, c, g, or t
  misc_feature (13238047)..(13238047): n is a, c, g, or t
  misc_feature (13238054)..(13238054): n is a, c, g, or t
  misc_feature (13814657)..(13814657): n is a, c, g, or t
  misc_feature (16285313)..(16285313): n is a, c, g, or t
  misc_feature (16338477)..(16338477): n is a, c, g, or t
  misc_feature (19402061)..(19402061): n is a, c, g, or t
  misc_feature (37702003)..(37702003): n is a, c, g, or t
tgcaggcgttctaaccaccgttctcctttgtgggcttccttctctataattgtctttgcagtacctaatgtggatctgtcacctatctgctccggcgccttcagaccgggtcctcccagcgcacaggcacaggtcgtgtccgagtccatcgatcgcgtcctgaaggagagcaaagtcttggatctgaaggatctgtgcatcgaggaaggaaaggctgtctgggcattatgggtcgatgtcgtctgtgtcagctacgacggaaatatctacgatgctgccctcaccgctgtcatggccgccttggcgaatggtaaaatccagaggaagaaaaaaaaaaagaaatacttttttttgtaccgtggactaatatcttttttttcctatttgtacgaatcaacttctggtagtccgcattcgcaaaccaacatacgatgagggcgtggtgaaggtctcgggcgcagaggacatgaacgacgataactctttcaagctcaagttggcgaggacgcccttgagcgccacctttgcgcttttcgatacctcgctgaccgtgctggccgatcccaacgactctgaggaatccatctgcgacggctccatctccgtcaccctggatgagcatggccagctctgtgcagtctcaaaggtcggagccggctccagttcacagagtctgctcaagcagtgcatagaccgaacccgggagcgagccacagagctccgcgccatcatgagccaacagcaacaataaaatcactcacttttttgtttttttggtctatatactttctacaaacgtctcctttcttgtagccattgagggcattgtacttcagcggcatgcaaagcgcctggaagctacgttttttatcttttgtttttttttttttgcttagaaccagctctgttgactgccaccgggaccttgtcctccattcgtccacatctctcgtggatcctgactagggggcatgatgggaggtgcgtggagagggtgcgacgaatggccgtgcgcgtgtccatggtgacctccgccgtatccatgtgacccagacgagtatccagcccgactgccaggtcgactattgttgttgctgtggctgctcggggtgtagtaggatgcaccgccaccgccaccaccgtaggccctcgagctggtggggaagggcaggtgttgctgcgacgagtgaccagagtgttgacccatggccgagttgcgaccgctgttgttgccactgccgtatccgctgttgtatccactgcctccaccatagtacgacgatccagaatgaccgtgatgtccaccatacgtgttattgcccgccatcatctcctcatccgaattctgcagcagatccaccaggccctcgaccaaccggaccatcgcaggctggtccagccagtccttgcccgactcgatcgcctggctcaagagtccatcaatgtccatatccgagtacatgtcctcgctttgacccaaatccagacccacaccatagtagccgagttgaggtgagggcgtcgaccggtggctgtcattgtagccattgccgctcttggactgctgctggtgctggcgaccctgctgatgggagctgttgcggctcttgtgatccagaatcaaaaacatcttttcaaatccgtcgttcatcaaatcccgcaacgacttcagtgtccgaatcgtccgctcggacccgttgaacttccaccagtcgtcgaccaccagctggttgtatccgacagactcgatatcgttctcgcccgcaaagagcaaaattgagatggggtccagacgcgtggtgttcctcaaaaagatctgcgtctctccagtccgcaccttggtcgagaacgcatacaatgatccaggctccggaacctgatcggcatacagcatcttctcgcccctcatagagttgaccgatccgggatggatgatacaggtgttgtcgtgtcgagtgcggtggatcttcttgctggtcttgtatgacacgttcgggaaaactccagcacaaatcatcgcgcgcaacagaggaatgcagttcgagttcttgttgtactcggccggtcccatctcaaacgctgacgcttgctcccgacgcatctggtaggtcattgttggcaccaccccagccttctccaacaaacctagcaattgagtcttggcccgcttcacattctccagggcttgccgactcaagaagttttggtctgtaaagttgaacgccgccctgttgggatctccacgctcccctgtacgctccatttgcgtcgacgcttgggtcaagacctcctgccatgcgttataggcgttcatcatcgccagatggtcactgttcaaatctttggcccacttcatcttagcacgatcagcctagaaacgtacatccaaaatttgtaaaagtgagaaaaaggcgaggcgctacagccgaaacacacatcacaagtgcatccacaaagactgttcttacctgctccttcttcatcataggagacacaaaaacatccttcgtgcccaaggacgcgcagagcgtcagcacagggtccagacagcggaagatacaactcaaaattaggcaccgtccaaagctgggctccactggcaaggtcgccaaaactcttcccagtggcgtcaaattctcgtgccggtccagcgcacccagggatgtcagttgcgccagtgcatccgacacactcagctgatcggggggctggatggcctcggctaatacgctagcgatctttgttgagctgtcgaccgacttgatgtgcaaacaaatctcttgcaggtcagaccgaagcatctcgggaatggagaaagcatcaaggaggtcccatcgttgcgtcgacatcatgcagtagtattggccttcctgaacacgacccgctcgtccagctctttgcttcaagctggaggcactgatccatgtgggcaaaagtgtcgtcatccgcttggtggggtcgtagttggtctccttgaccttggcactgtcgaccacatggaccacatcctgaatcgtgatactggtctcggcaatgttcgtagcgagaatgatctttcgcatgccgggatcagtgagtggctcaaagacctcctgttgagagatcgagggcaaggtcgaatgcagcatgtgaattctgaatttgttggtgtcgttgtagtcgatgcccaggggtgcagaattgatgagctgtcgatgcacctcttgcatatcctcccagcccgacaagaagcaaagaatggccccagaaggcgcacttgtcttcacaatgtgggaaacggtcatggcgataaggtatgcgggtatctcagcgtccaggacttcgtcgcggggcatcctggatatacttctagcctggttcagaatgctctccgcatagtccagctcggtgtcgtcgacgtcgtccagttcatcgtcgctgtcgtaccttgtgggattctgtcgctggccggccggatggagtggttgaggtggcccgactggcaagatgctcatctcccgctgaatgtacttttgagtttgctcgtgtctcgagaactgcgacatggctgaggtagggtgcttttggtacatagcatccaagaggtcgttcaaaaagtattgcttgacagggaaggtcctgccaggaacagagatcgaggggcactgtccactcttgaagccctcgccaaagtacgatgcaaagagtccagtgtcaatggtggcgctcatcaggataagcttgatcacgggcagaccctttgcacggcgctcccgctgcatctgcctcaggaggaccagcaaaaagtccgtgtcaatgtcgcgctcgtgcacttcatccaccacaatatgactgacgccccggagcgggtcgtgcgaatttccaccggcacctcctgatccagtagaactgttgcttccttcgttgtgcatcatgcgcaagaaaatacccgtggtgcagtagagaatcgatcctccgggtgttgggggctggttgtcgaaacgcacttggtatcctacagactgaccgatccgctcaccgcgttcgactgcaacgcgttgcgcaaccgaaatggcagcaatcctgcggggctgcgtgcaaatgatgttgcacactcctccctgacgattcttgatgtagtcctcgaggatgatctggggcaactgcgtggtcttgccgcatccggtttggcctacaagcaccacaacatcattgtcgcgcaccttgctggtgatttcgtccgcatactgagtaatgggcaagccagcacggctgtcccgcagcttggccagtgaagggttttgtttgtaggccgcaaactgatcaaagagacgggccgactttccggctgcctgttgtacatccagcttcccgaccaaatgacgattgtgcctccgactgttgttggtggcgggctgctgattttgctgcgccttattttcacgatcaatttgcgctggggtctttgctccgagctgaggacgcttgacggtgaaaaagggctgtcggctgaggttgcccaacatgtgctcgatgtcctggcgcatgttctcatccatgcccacgtggacactaggtgctgctcgcaccacgtccgcatgcttccccttgctgtccttggtcgactcgaactgttgccagatccccatggactccttcttcatgttgacagcagcgtcaatgtacgcaaaatgctctgcctccttcttgcttcgctttttgcccacgcccatgacgcgatcctgaacaaacagctcagcctgccaaagcgcttgatggatttttcctgtgctgtggtagtcgatgtagggtggtccaagcgagaaggtgcggatgtaatagtcgacaaactttttcgccacctcgaccgtgaaaccagactcttcagcagaacctggctgaggcaagacagcgttggctccgcgtgcgatcgcaatctgttgaaactgtgcggccgctgcaatctcggcctcctcagttgtctgtcccttgcccgtgccaacaatgctctcaaacttgagtgtcgagatgacagccttggttgctggatctaccttggtgtcgtactttggcaagccgaccttcttgttggtgaaaaagttgacggcccagtccttgggggatttgatgacgctctttttgccccgtccgtactggcgatagtactcgatcagcgaatgtttctccaactggtaacaaagatcgagcgcacagatcttttctgcgtctttcttgttcttaccatcacctctgccagtgatgatcaaagcggggtccggtgtctggactttaaactccatcctgacccagttcataggcaaccctggtgtgggcacgacctcgaactgcggctggggctcgatcgctctgcacaagaactggagaaagttctttgggttatcccaccaacgctcgcccttctccgcggtactgtcggagcggttggtgttgtaggtggtgtcgagatgatgctgatcgtagaggtagatccgctctttgaccggtgccggccctgatcggccacctccacggcctcctccacggccaccacgaccaccgtggctgttgcccctgtatccactgttgtagttgctgctggtgcggcctccaccatggcttgagctattgttgtatccgcctctggggccacgtcctggatggcctctgtgcacactcggagcgtcggtctggtccaacggctgctggtggcgatggggaggaggcggatagggcgcagaggaagagtcgttggcaggggcgggctgcaggtagtgcggatggttggggttgttggtgttgctgttgttgaactgtgcagacctgtgcggtggttggtagcgtggcggcattctcgtttgctattgtttttttttcttgtgatcagactggatcttgctgctcttgtgcggcaatgctgtgggcagatcctgcactctctgttgctgctgtcctgggcggagattgggggccgttgactcctttgttttcagtctagagtagcaaaaggacaatagtgttagaacacgggcaacagacactagtgcttcagccgcggttgcgccaaggaccaggcggatgagcacaggcagcagtaccgaaacgcgggcggtttaaattagatgagacgatgcagacgtgccgatgccgacgagataaacgaaacgaaaccaaaaggcaaagaatgaaaaacgaaagcagaacaacgaggaagggcaagcggacgagagagagagagtgggggtgagagtaacgagtgagtgggagagcgagagcgagagtgaaggacaggaagaaaaagagaacgagaaattaaaaaaaaaaaaaaaaaaagagtgcgatggggaggagtggatcgcaacaagagagataaaaaaatattttacatgatttcgtggcgttgattcaaaatcaacaagggcttgctgtgtggcctggctgtgtgaaaccatatgaacaaaaagcatgctactgcaaggcctccactggcaaacgcaccttgcaagctcgtagactacgattccgctcctcgggtcacgccaggcgtatatctcgcgccatctgctctcctacaaacaaacctggtcacgaacgatagcgtggccgccacacgccattcagcatcatccgcaaaccggcaaatccttggcttcctcctgtttaaagtgcagtacatgtctctattttgccttttcttttatttggatggagccgttcgccaagcacaaactcgctcgtctattgatgaagctcgacataattggctatcacagtgcaaaataagggggaggcaagcaatattgagtgtttagcgccctcctcaaaaaagcaatcgtgtcgcaaaatgaaaatacaatcacttacaagggaagaggccgttcgtgccctgcgtggacgtaccactccaccagtcgtccgtgacaaactacgcgcatcaaacagggaagcattttagcgcatgcacatatacttgtcccaacatgataagaaattagctagaaacgtctctgtcctttacctcaatcgatgtgagaacgtcgccctccacgaatgaaatctcgttcggctctccggcattataatcataaagtgccacggctgaaggctggcccgagtgcgcctcatcgacagtggcatagccattggtgacggctgcctcctgaacatgctcctcctccgcaatggctgcaggtgccgcgtattcctcagtctgctcgatcacctcgacataattggctacacagtgcagacgggcgttagcgtaggcatcaagtcgatggtccatcagcagctacgtgccgctaaacatcaaataacgacaaatggtctggacgcttacctgggaacagtccacttctcgaaccatcagtgctctcgccactccaccagccaacatcgagctcagtcacattaagaatgacctcgccttcgatcagcgacatctcgttctcctcggctttttcgtacgaataaaggacaactgcagaaaccgatccaggggcaccaagtgcctcggcgtgtgctggttccacatgggctgctgctgctgctgctgcagcagcactggcggcatgctcttccttcagacgacgctcctcttcctcttgctgagcacgtctctgctcctctgcttcttcattctctttcgcttgctgctggcgtctcctttcctcgtcctcttgttgctgacgctgatgttctctctcccgagcctcttcctcctcacgctgctgcttcaaacgcctctcattcgcctctttctcatccttctccctctgacgctgcagttgctcctgctgtctcttttcctcgtccgccttgctggccagcgcacgaacctgcacttcctcccgtgccttgaacgcctcccgcgcagaacgagctgcctcctcagcctctgctgcctcgcgctcctctcgctcacgcgccgcacgctcctcgcgagcacggtcctggcttcgttgttgctgctcagcctcctgctcgcgttcacgctcttgctgctcctggagacgtctctcctccgcttgcctttgagcgctagactgctcctgcccctgcctctctctgctttcactggcttcaatctccctcttgattcgttcccgctcctccctctcgcgggcttcgcgctccatgcggatctgttgagccttgttcatgctaggctcattgggcgtcgaggctccatagttgagcaacgagctcgggggagccaccttgttgaaggaagcacccgacgccgaatacgaagaaccgcccgtgcttttccatgaccgttcagtcgaggacgaagggggtgaggccgcgcttgatggggatgctgccgacgagttccaagagcgactttctggcttggagctggggggtgtcgaaggagaggtggatccgaatggcttggaggcgcccaatccatactatagcacacacacgacaaagaacaagccaatgtggcaaaaaaaagttgtcaaaaatcatagcggtgacactgagaatgctccaatccatgcgtgtcgcgatcaagtattttctggacgcatcaatgtgatatataccttgggtgctggttcgggcttggtggggttacgctgcagagccgcaatgtcgggaatctcagtctttttgtaggcagactgcaatggggtgatgcgctccgtcttctgtgcctcgttgtggaaggagtacttggaaccagagccctcgttgactcgcttcaagatctgagcaggcgtaacatctgcctcacagcgagcgttgatttgcaaatgatagccctatcccacatcatgacccaaaaaaaatgaaacaaataaaaccaaggcgtttagcaactctcactgcgtgcgatcttcaatccacagccctgcaaaattcctcgtgccagtaccttgagaaagagcgacacatccgctaggtgggagttgaagaggcccttcttggattcgggcacgccgtcgccacactagtccagttaaaataaaacaggaaaacggagagcaataaagagcgttaacttgacgaggccgcgatctgaagtatcctctgttgagcactttgagctctatgggtgcgatagatccactctgctcttttcttcttcctgttttccgctttgtatcatgaagttccgcattccagagtgctgtaaagtctagtgtctgcagatctttcgttcctgatcctgaacacaaatagtctagcatgcagttataagccgtccaaagcgtctgtcgagggagtgtccacgacgacgcgttgaacgcgaagccgctgctggaatgcattctcaaggacgtcatggactcgaaagcaacttacccagccgatgaggataaacttgttcagctgcgtgttggggtcgacgattctcacgaacgcgtactgaatcttgccatccgcaaactcatcctccaattcctccaggccaccgctgccctggctgaggaccttcaggtcgttcgtgcccttgtcgtagccgaacatggcccagttgtcgctgctctgggggtcggcgggtctgaggatggcctcatacgcagccctgaggtcatgaccgtgggctgtgaagttgacttgaagactcatgtgggatgcgtgtttcggggagtggatgtggttggggttgcaaagcagcgatgcaggtcttcgcagagggacaaaacaccaaagaggagaggaggaggaaaaggagagtaagagggaatgctgagcggataaacgaacgaggacgacggatgatgaacagacgaatgaagagtcaagagtcaagagtcaagagtgctcgagaaataatggctcccaaacgtcacgtcgcttgcacgtcgcctgcacgtctcaggcacgaaagaaatttgcacctccagtcgcgtccttgcaagcgcgctccttgactcctcatccacggcagagctgcgtgtctaatggtcaatgcctctaattcaaatacaactctatctacatgcattacatggtcaagactatggcacatggacagcacctcacgctaccaagttctggatcgacatcagatcggcagtacttcttctgcgcccatccaacaccttcaccctctccccatccccatccacatccgcatccagctcactcgcgccatgtcctgcctcgtcgctctccaagcggtactgcgtttgtccgcatcgctcctgttctgccaaatccgcaagatcctctagcgtcgagtacgagcggcggtgcacggcctctgcaaccttcttgcgacctttacgcccacccatgtccgccatgacgctctgcgtgagcggtgtgctcaacagtagacgcggttgcccaggaggcggcgaaccaaacataccctccctcctggggctggtgggtgctctgtgcgacattccaacaccgctaaaaggaatagactcttgaagacggctcatggaagctgtatacggccctgcgtgctctggcgatccgtcctctcttctggataccgtcgggctcgagagagacgcaaagccgtcgtaagacgacccagacgacgaggaggcacatctcgagattctgtagctcatgctcgactccggcctccggtacgggttttgtgggtagcggaacgaccactgatcctgatgaggtgagtgctgttggggtgtgaaacggcttgaggcctgaattccttgatcgatcaacgatgtgatgcctggcagggcagtaaagtgcctgtgcgtggcgtgctcttgcggagatccagatgcccatggccatgagtggttgggtcgtggcatatcaggggtttttggaggagatgggggcagtaggtgggcaggggaggaggcacatcgaatcatggctgcagccaacatggacggcggagccatagtgttgtgcacgggcagagaatgcctgcgatcgtacggcaaatggcgcaccgctgctccttgagctgcgacggccttggcggaggacgatagcgaaggcacggtggcatgaccatgcgatggatgctgcggatgactccgctgctgcgcgtgaaaggcgtgatcttggatcatcatcgagggcatgctcatgcgcctcttcttgcgctggatcgtggtgttgaaatggttcttgatggcattatcaggacgaccaggcatatgtttggccatctcggcccatttggatcccatctgcttgtatagctcgagtatgcgcatgtcctcctccggtgtgaatggcgtcttgttgactgaaaaggttgcgttggtaaagcaatatatcagtgactgatgaagcaacgatattcaaaaaagaagggctagaaatcgatccatcatgtttacacctactctgagggtcaagatgattatgccatcgctctcggcactgcttgcccgtgcgcgacccgatcttggacgctatgaacacccacttttcggggccatattcttccaccagctcgctcagcttcctatcctcctatggaggggcaggacaatgtgtgtgagtgatgcggcttgcaagagctacaaacctattttacctcagagcaccaagtgttttttttttttttttttttttttacctcctctgtccaaggccctttcacttggcgtgggcgcgtcgaagatattgcacgccaccgctgcaagcactcgttgcgatcgcgcgaaccgtctgggaaggcatactcagacacggatctccaggactttgtgctgcatgtatttaccgcctccagcaagagacgatcctattggcgttgaaagagcacgaaatcggcgaacgataaatgaactgttgattgtttgcagagacagtgagggcttttgtaggaggaggatcgaaaaggatgaagagaacatgcagttgaacgtacttcatgtcgctgccaaggccggtcacagtatgggtaggggccctgcctagccaactgtgcatggttcagctcagggttggaaatcggagaaggggcagggtaagggtacaaggaccctgtcgggccagcagagctaggcgaggcgaagctcattctttccatagattgctccacagaaagagcgttgagattcaagggtgtcagtgctgctggtaccttcatactgaagggtcaagtacagatatattatgggttattagataagaggtagaagaaaaaaaaatagtgccgagggtatgtagcgagagggcgagggcgaggacgaggtcgaagaaagtggtttcttatatgagtacagagggtagcgacgcgggccggggtgtagcagttgatcgttttcacaatctccgttagcaaagccaggaaagatgaagaagtgctatgggatacaatgggatggatccggatgggaatatgggtgggaagaagggaaggaggctgaaaatgaatggacacagcctggagaatagaaggagccatatagtatagatagaaccctcatgtgagatgtggctgccaggtccttctgtcatccagcgtgcgacgctgtgcctgggggagactggaatagaaagatggcgctcctccttcactcggtattaaagcaggtgtacatcttagaagacggggagcaagaacaaggggctgttcgcaaacggaggcatggatgctcacggtggatgtgtgcgacgtgatggtggcatggtcaagagcgtaacgcgttacgctatatgttggactagagaatatagagagagcaaaacggggaaaaagagtgagaaagaaataggaatggaggacgaacatagtattcagggtactggagcagaagggggaggggagtgtagacgtaggcgcccttcccgtgtttaaaggagaccatcctcctttggtttacaacaccgagggaacgctgatgagcacggatacagtgaggggagtgaagataggactgtgcagaagaagactgagcgaaaatgaaagagagggtgtgatcctcagcagcggaagcctgagagcgatccatggcgccgatactgcgatgcaaagggcgagagtacgaccttggagccccgttgttatgacctgtgcaaccccgcctgcatggacgatcatccatccagctagggagcttgtcttcctaggtcttttgcgtgtgagagcaagagcacgagagaccgctatcgggaatgaaatcattttcattgtcgtttttacgcgcgtcctttcaaggggatcttgctattttcaggaggtgtcaagtgcacagaaaaaaaaaaacgttctgagaatgtggggggtgcattacggctaaaccgcgctagagaggtttctcgtaacgtcgttgaacacggtcgtgtgtctcccatggtcgcctcatcggcggtcttttggaggagccacccaaggacacagttgtggatggtctagcacaagaacaccgtagactgggctcgaccggcgtcgatttgctgagcagccaggagagacgtcggtcagagaaggagtaaagctccgataccgcaaagaaaaggctgcctggaaagttgcatcgtccgccttaggagtcgctgcctccttgaggacacacccttgtcaagtagggattgtggcctcttgacgagtacagatcatgtgatgccgaaagtgaccggtgtttatcttttttcttttttttaggtctctgtttgcagttgcatgtctgtgcctcaactgctgctctggagtgacgagactcttcattcacttctcattcgccgcgcagacgcaggacaacccccaccccctcctcactcgcgatgaacaaaccaaaggagagccggccctttgcagctcggggaacccctagctcaggggttggtagtacctccacccacaaacccttcgcacgggacgctcaccgtggtggtgacaaggacgacagacgcaaaccgttttcaaggccaggagacagagcagcaccaggcgcggcacgacccggagctatgggagcgccgtcattcaacaaacaaccagccccttacaagcggccttcggacaaaccagcgccttccactgcagccgacatgtttgcagacgatgacacgaccgcgacgaaacccgccaaagtcaaaaagcccaaagtgcctaaaccacccgtcgatcccaacggtatttctcttgcactctattctttttgcgcttacctatggtccagtggttctcaaaagattcttctccctgcagcatgatctgacctcgtccccgcaatcgcacccatacctcttgtcgatttggatagagcacatctcgcagagggcgttcattggaggtctagccaacgatatcacgcccatggacgtcgagggtcgattcaaatcatttggacaactgaaggatgtttatctggctaaagacgtggatgggggctgcagaggcttcggctatgtcaccttagatacaacgaggaaagattggtcaaagtgcctggcgctgttcaacggcgcaaagtggaaaggacacgttctgaagattgaggaagctaacaaggactggcaaacaaggtacacaacacgaaatgatgtgatcagagtgctgtggggaccgttttagacctttcttcgagggaaaaacgacattgctgaacagcgctctctctttctgctggctttacatctgactctaggcggcaggaagatgtagagaagcaaacaaagttggaaaaaaaggcacaggacgcgcttttgaaaaaattcaagaggaacccggtcaagcatgcagaggatatgtcattgatcactgacaagaacatggacggcaagcgtggctggaagagaggtcgctttggaagacccgtcatcaccatgaagctggatagggtaaggcttcgacatagcagtccttctccatcgtgtggctcgttcagccaacttacagcaccatgacgctgacggacgaattttacacttgcgaacacttggttatagatgacatatgatccatcgcactttaagaacaataccgagaagattgtcaacgctacaggaaagccattacctcttgaccagttgctgtatcagatcgacgaaaatgagccccttccgaaaggaaagcatctgccgacagaagtggccttggcaccgttcctttccagaacaggaaactcggctcatgctcccaacttcgatcatcagaagacctcggcggatggaaagaaggagaaatcgcattcaggtcatagtgaacccagaccggaatctcaatctcaagcaccaatcgacagggctaccggatcggacgatcgggctatgatggcctcggtcttggcaggaatagacatgagcccgagagcattgtcgttggatggatctgatttcgaggacgacggtcatgacgggtacatggaggactttgggtctcttgacgacacgaaagccgacgatctgtttggcgacatgggcacagttcaacctgcgcgccccctttcaaaatcagaacgggactctaggccagaggatctgtttggaagtgacggcgatgatgacgagacagaggcaaaccgaccctcactcgactttttggaagaaggcgatgatgacgaggatatggagagcgccgaggaaggtgaggacgatgagggagtggaggaagcagaagaagaacaagaagaagaggaagaagaagcggacagcgacgatgatgatagtatggatgacgacaccatcagggccatcgcacagcttcaagagtcgtcttcaaccagtgcaggaggcttgtttgactcggacgacgaccaggcggatgcagataacgatcaagataccaccaccaccaccaaattcgccgaggagtcgaatgctgcccgtttgaaagcccaagagtctcgtgaggctgaactggaggccgcgcgcggcaagcaacaggaactcattgcatccacactggctaatatggactcgcgggacaagaaggcgggacacgtcgtgttctctgaatcggatgagtatgatagcgaggattatgagcagatggaggccgaccacgcgaagaagctggccaggttgaataagcctgccaaaagcatattcgactcggactcgggatccggcgaggaggacgacgatgcgatggtgccccgccgcaaaagaaagggtgtgaaggagatgtttgcctcggatgatgaggaggatgagaccgccgctggcttcgagaagcttggggagccaggtaagcctagaggtttctaagacagccacagttgtctagtgcttgtagaactgaagtgtctaacatgcgtccttgttatcgcccgatatatatagacctcaacatcaaggagcagtttgagggtcctggaggaaaagcattgtttaagatgcagacgagaatcggcacgaccgactctcgtttccagttgaccaaggactttttggatgaccggatccgggaagaggatgatgcagactttgtggcccatcaggatcgactgaagattgacgagtatgccacgggcgggactggagctgcagagattgtgttggatgaggatcgacaagtcgagtcgaacgtgtcggcggagaagatgcaggccatgaacgtgttgcgcgccatgtttggagactctgttgtgaggagcaaaaagaaggacgaggacactgcacgaaaggccaagggtggtcttggattcacggctggactgacggttcgatacgaccctgatgctgcgccaccaccgccatcatcacctcctgccgcgaccttggaggtgtctaaggcgagcgcctttgaatcagaatcagacatcgaacagacagcagagtcggctgaggacgaagatcagagtgaggtggatgcgggtgagacagaggaagaggaaaacgaggaaatcaacacggcaacagagacaaaggagatcaagtcaccagtcaagaaatcagtcggtttctcattctcgttcgacgaagatgccttgaacgcggacgaagacgcggcagagaccaaggagaagacctctctgttctcagcagcacccatcaacactgacaaatcgcgcaagtttcaagtagcaacggatctaaagtcgcttttcgcgcccgccgctggaggattcaagatgttcggcggcgacgatgatgatgatgatgatgaggacgaggacgaaagcaagggtggcgatgtcgaagacgatcgccaggacggatccatggccgaggacggtcgtcgcgatgaggaaacactgatgacctcgtacacggatggctccaggaccgtctttgtcagcggcgctgaggcactcaacagggcaccactctcccattcaggatccatgttcttcttccatttcaagaatccagcgctcctgaagaggttcgtcccttgctgacatgcgttcgcatgattttcagtgaccgtacaccgactaacatgagctgcgtctgaaaactgcttttttatatcgtttgcgccccttctagatccaactttaagacgactaacaaggtcttcaggaggacagacaccttgtatgtgtgagaaggatggtcatatcttgactttgacagaagaatcgcggttttctaatacctttcttttcttcgatctcaacagggacgaggtcaccgcgcagtgggagaagacgcggcactcgatgacgcaagagttcaagcgcaagcacaagtcagcatccagaaacaaggccagagcctcaaaacggttcaaagctggcgcaggcagtagcggtggtggaggaggtggtccagcagatcatcaagcttgaataaaaacaaactattccaatagatatccataaaaagtacagacagcatctcactgcattgtttcgagttgtatttttctcccgccaagcactccacgataatggcgaagcgcatcgtgtttgcggatcaaatctaaatatcctgaggcggttacgacggtgcgccgacaggtagtgcatggccgaggccacagcagtcgagcgagcgcgcagtgtccacatcctcaataaatcatagttgcccaggagcccatcttcctctaagacttcttcttcttgggtgtctgaaggatctccatagcatcatcatcaccgtctccatcgatatctattcataacgaatgagactttagttccttctgctactcagacaatggtatagtgatcttgttctttgacacagttcatcataagggttggcccttgtctatttaccgataaagtccgtgtccagagcatcggaagcatgacccgagaatgcagaggccttcttgagtctaagaacaacgcgatggacgggttgagacgatgaatggactaaaccaccaccctttctctcgttgactttctcattatcatcaacatcatcatcatcaccgccactgccagcagcatcgctgctgccatcgctgtgctccccatcgcgactgccaatggctcgcaaggtatcatgaaaggataagacttgcccatttttacttgatgaactcgatcccggcggacgcttggatgaactcacgcctgatgactttttcggattggaactggagagcttttgaggcgtgctgctgttgctgccgctgttattgctgctacctccgccgctcccgttctgaagactccgcccgttggccaagagcaggttatcgtccagataccccaacgagatttcgccaacaggaggttgtgtccccggtgttgagactgttgaaggcgtatgaagcccgagacccttgagtttgacagagctgctcgcacttgcctttgaagctaagatttagagaataggaatgagaaaaatgtcgacaacactagagcacgtttcctttgcaagtgatcccgtgctcttaccttttgccaataaggacgactatcgaatatacaaatgtatgggcatagagagacatatcagtcgagagctatcatactcaaccccttagtgttgcgaaccatggcttgaacctttaccttttgagtcttcacaggataatctgaagaatcggtttctaagaacgatagcgaggaagcagagcgtgacgccgtggtgagtctctgacataccagtttatcgcatcatatcattctctggcatctttagggctaaaaaagtcgagcatcacatacgtttctgctttttgacctttgtgccacctgatgacgaggactatatagatggtaaatggaatcggtcaataacctgggcacagcaagccttggttgccaacatcaatcagagtcatcgcgtgagacttaccttggtcgagctgggtgtgccgtagtcacctccgctggatccgttggcaccatttccgttggagccgctgattgtagtattctttttgcctacaaatgcccattcaatccaattgaaaaacgctgttggtataccggagcttagatcagagaccgtgctgactgaactcgacacacatcttacgtttcttttccagtagatccttgtcagagtcgctagcctccctgtcgtcagagtagctcaaaggggtaaatggggagcctgatccagcccgttcgcccgttcctatcctattggacgagaacagttgccaaacgcatttagatgtatatcgctgtgaaacaatcacagatgaaccaccgacaacattcaagagtgtttgatgtacctgcgactggctgtccgactagacgtccttccagagagtccaagacatttctcgagatgtggcgcgtagcgctgagcaggaaaagatcgatgacattggacgcagtcgtacatctgcgagttgtttggctggggattttgtccaaaaatgtccacgcctggccgcacaactacgggtcgaggagagaaggcaaatgtggttcagtatctgtgcactcgtgctttggtgaagagtggtcaaagcgattcgtctcaatcatgtaccatagcttctgcacctatacaaaaaaaaagggagcgaatagatattaattggccgcgccaatggtttggcagagctcgacaagtattgctacgggcaggatcgtactttgttttgcagataggacagttcgatcgtatattcttgacatcccggtgagcctctaccgccacatcaaggatcagttcatccaatagctctccaagaatctcgaaagactagagcattgtaaaggagcagaattgtgggtaagggtcaatgacagacatgcgatgggctttgcgcatcgacagcgctgagcccacgttgaagtatgtaggggagcacatggggtaaggccatccaggcacacgatcacggtacgattaagcaaaaaagaggaaaaaaaaaaaaaaaagaagagtgaaaggagagagagagaggacaaaagcttgagctcgtagcttaccaagctggccaatgagacagccttggaatcaccactgtccttggaggctatgctcttgtccatggcgcgcttcgtatgccgtagcatttccagctgggacgcttggtccttgtgtatttttgcgaacagcctgcgagaacaaaaaaaaaagagcaacacgtagacgcatggcaagatttgaatcaggaaagagagtatgcattgcgagcaccttctgcaaggtacgccagggcaagcactgcaaggcaggctgatgtgcaagcagcagaccctagtctgcttgagcatggaccacaccgtgccaattggcgctgcaaagatgtggagcgaagggaggagcaggacttacgcctccatgtcgctcgaggacatggtgctggtgctccggacgagcgggctggccatggaggagctgtccgtgggtgctggagaggggagtggagaggcggcagggatcaatagaagcggtagatggtgtgggagggctgcagctggaagtgatgcaatcggaaaaaggggaggaagaccaatggacaggaagtaaacccggtggaacggcgaaagaggacaggtttttgatttggacgctcagaaatgtttgtctatgctacccgcagatcctccatctcagcctgcagaccaggactctgctggaaggacgcctcgcccacaccaacctcctgcatcaagcccagcacatcgccagtgcacagctgcatcaccatggcccgcagcttctccttggcatacatgtccacggcctcatcgcccatcatcgactctgcaagctgcttcagcagcggcttgggcgtagggaacaccttgaccactacgttctccacctgcatgtctgagggcaagtgccctgcgctcttatgagcctccaggccataatcgccagccaagcgcacagcatacgacagtccacccagtttgtccaccaatccagctacatgttgtatatcgaaggagcgacagaagcaaaaatgtgagtgcactcgtttccaacaaggtttcacaagacaatcatgacctggcgctattacctttcaatgcttctttgccgttcatgacgcgaccgccagcaacattctccacttggtcaatggtcatctttcggccgtcagctacccgtttgatgaaatcagcataagttgtatcgatctgtcgcttgaacctggtcagagccgcaccctccagatcgttcaagagtgatgtatccgaggagccggtaaagaactgttcaacactgacaccgatgagcttgaaaaactcgggtgtaaagtacggcctcaatgaggcgactccaatgcttcccgtgacagtggtggctaatctccgagaagggcatatgccgggtaaccaatgcattgaattacagcaagtgtgtcagtaatagtttcgacagcaggaacaaactgcagataccgtacgagagctaggacttacgttgagcaacaatagctttggcgtgggtggaaacaaagtagccgccgctggccgaggtatttccgaagctgacaacaacaggcttctttttctcatcctggcaccatcggatggcatctccaatcgtgtcgctcgccacaacatcccctccaccagagtctattctcaggacaacagcatccacagatgggtcgttggcagcttctctgattcctttgacaatggtattggcgccgaaatcccccccacctctagaattgggaaactatattattagtagacgttgtttttgcagtcgtgcaaggtcgagcatacatgtccttgatccaagacataccgtttgataccgccaatcaaatagacgattccgaccacaagactgggctcgcctgtcttggcaagtttggccgtgtgttccttagcctttacgcgcatgtagtgcgccaaaccaaaggctccgttatcttcgaccattttaccacagtcccgcttgtacagcagaccgtccacgagcccttcatccttggcctcagatcccatgaatggtccaatctggatgaggtggttcagtttctcaacaggatcacttccaagaactttctgtcgcgactttgcaatctcggccaagatctgtaagttcaaccctttgagaagatcaaacaagttttgcttttgaggcggtggcagttctgtttccgtgaaggggctgaccatgctcttgtattccttgcgtgcctcggcgcgcactatcgacgcgttgatggtggggtccgtcaggcttcagaattataacatttgctgtggatgatcctgtgcgttcttcttcttaccttgaatgccaaagcgccccagtagagtcttgaagaatgggaccgtcgaggacaagcccaccaacggaatgctcccgctaggctgcatgtaaaccttgtcgaatacagaggccaagtagtattgagattgattatctacccatgcaccagaaagacaagtcagttcacatatcgcggaaataaaacgaaatttctatggaacgcaagaccttcccagagtttgtgccaaagcataccgaacgaatctgtataggcgataagcgagactttgtcctcgccacccagagccttggcctttgcctccttgaactcctggaccgcagtgcgtaattcctggatctgggctagtcctagaggtttcgcctgctgagtcttttggttggctgtcgaaaagttggccatgataccgacaattcttggatcatctttggcgtgtttgatggcagtaacaatgtcgatcaaggtcgagacgggtgccggagaactgcttcctgccgccctcaataccttctggtagtaccccttatccgtgtctgtctcgacaatggatctatgttcgagtcaggtatgttttttgcccctttagtttctggcgtccactcttgcgacatgtcattgctccttctgcgatggatcctcacccgtccgtaattcgccagtgaagaaccgtgttgggcggaatggtgtccctgatcttttgcaggcgccaattgctaatgatcgagttggacagggttggggccaattagcttttgccatccaacgaaagtattgcagcttgagatcaacgagacggatacttgctagaaaaagttggcactgctgtagaggacaaagattccaaaggtgattttgccacggttgctccatgttcgtgaaaacgcgtttggctttttccattgtcctccattttgagtcgactgtgacgatgcacctgcagagtgagcattcgaagcagcctgcgctccaggtgtagcacccgtcgcgcttcctgctacaccggcagccgctgcagcagcaggttccgttggtgtcgttgacatgttgggttatggagtgatcaaagaggctgtctgggttcgcaagaaatgaaaattatttgtttgacggtcgcccctctcaaactgatcagttcaaagtagcctcacaaactgtgtatgattcaacgcgcggcttctcgtgcctcaggttacaccacataaactacatagctccatagcttgcatggctacgtatatttgatcttgcgagggagaacagacagctaggtatacaggtttgctgtacagcggacttggaggctccgtcgtggagccagcaataggaatagagttacgcccttgcagtggtctgcctgctatacacctgatatagcacgctgggcggtagatctgccagaatcgataagccagccatccatcgagagaatcgctcaccccttttttctgagcgaaccagtcctttgacttggcctgatcctatttgccagcgataaatttgtgctcaggaatctcgccagtagaaaccgagtcgtgtctgggctattagactacttgacgctgtgtgcccttctcgcttccatcctgttctgtctgtgggtccatctgcaccactcgccctgtctgccttttatactcgttccctcgtcgttgctcgcttctttcttccttcgttatcctttcctcattccttgctccttcctccagtccttctgcccctcactcttgtcctctagtcccgctcttcattccccatctccctccctgcacgcgtgcacctcacattcatactctcacagccactgtcatgaaggccactttccttctcgcttccctcgccatcgccgccgtcgcctccgccgctggccagaccttccttgaggagaacttttccgaccccaactgggaagacgtaagtgcccatatccataaccacacgctgttgctacagacatgcggcttcagagtcaatgtttcaagtgctcacccacgtatattgtccctcatttactcttcttaaccttcaacctagcgctggacggtttcctcggccaaggaagatttgggcaagtttgctctctcgtctggcaccttccatcccgacaaggagtacgctcagggtctgcagacgacagaggaccaccgcttctactccatctcgagccccttctctgcggtcgccgacaactctaaagatgatttgatcgttcagtacactgttaagcaagagatcaatcaggagtgcggaggatcatacctgaagcttcttcctgagggatttgacgccaagaacttcaatggcgactctgaatacgccatcatgttcggtcccgatgtctgcggcgctcagaaccgcatccacaccatcttcaactacaagggcaagaactatctcaccaagaaggagttccccgtccccagagacagcaagacccacctctaccgtttgactgtccatcccgaccaaaagtactcgctcttggtcgatggcgaggtcatgattgaccacgttcttctcgaggagcactgggacgtctatgcccctcgcacgatttctgatcccaatgacaagaagcccgctgactgggtggatgagaaggagatcgaggatccttcgcatgtcaagcccgaaaactacgactccatcccccgttacatccctgaccccgaggctacccagccagaggattgggacacagagtctgacggcgattgggaggcccctgagatccccaaccccgactttgaggagtgggcccccaagttcattcccaaccccgcatacaagggcgagtggaaggctgcagagatccccaaccccgacttcaaggaggaccctgagctggctcactacaagattggtggcgtcggcttggatctctggcaggtcaagagcggatccatctttgacgacattgttgtcacatcggatgccgaggtcgctgacaagtacttgagccaatggaagcagaactttgacaaggagaaggcccttgttgcggccctggacgagaagctcaagcagaaggaggagaatgagaagaaggagcgtgaggccgcccaggctcttgccgatgaggccaaggagaaggcaaagaccgaggaggactccaaggacgagaaggatgagctcgatgatgacgaggaggaggctgtcgctgaggacgccacgcctgacttcatcaagattggtgagcctgaggtcgccgacgaggctgagcctgaggttgtcaaggccgctaagcctgaggttgtcgagaaggagatcaaggaggagcctaaggagactaaggaggaagtcaaggaagaagccaaggaggcagttgaacctgagatcgtgaccaaggacgagaccaaggacaccaagaaggaggccgcaaaggactctgaggaggacaagacccagcacgacgaattgtaaaataccatttccatatacgacataatacgatatcctttttgcactacagccctccagatccatttttgtagttgtaggacgatgaaatactggccagtgtgggcatggcgtgtgggtggaggtgtggatggctgaattataacggctttacctggatggttgtccctcgttgtcctgccacgcggcgcgtcactctgcgccaccaagtgactgcaaattcggacgcgctgaagaccaaccacggacgggttctcgactgccctcctccgccactgctctttccattccatggtcaatgccctcgacttcttcccatcaactgcccagaggcacatcacagatcaggagcgaaggcagcttgacattgactgcggccaccacagtttagtggcgaacattcctttgcggtaagtctgatcttgagccagttcagctcagtccactcctcactgtcgcccagctggtaatcgttcttgaatattagatatatttttcagtatgcactgaaccatttgcaagcggaggaggacccgaggaaacagcacggggagcaggggcccgcagtacaagcgcccaggtcggtgctgatcgttacaccttcaaaagctgagcttcagcgccgcatgcttcaggagcgagatctttataaccaccatcgagacacagtgctggaccagccgaccaaaagtcaaatggatgatcatttggccagcaccgtagacccttggcatcatttattccccacggaaagcccgctgtgtacacaggacgagtttagctcggtgactcaaacacaaacacagacgcaaacgcagacgcaaacgcagatgcgagacgtgaatggctcaggacatgttcacaaggctgcagatagcacgatccataaactcgcagaggatactggatctgaagaggcatcatttcagccagagctttgggcaaggattcagattcggtacgcgcctaccgtttctcatctccagtcactcttccggtgtttacatgtcgatgcagaggcgactcgcggcaggacgtttggacaggatatggacggctcaaggtcagaatcagagcaaagcaggatgcctgtgccctcactcgtcctattgatcgggtgctttgaatccgaggatatgacaaattttttgtctcgcccgacagtgactgtcgatccgtcgagtagtagcaacgaggagtacttagctctgccgctgcctaggcaccagcagcaccggcagtctatgcgcgcatactcgacaccatatggtgaacaggagcgtgtcgatcgtctcaaaagtatcagcaaggcgatgagtgagatcaaggatagcctggaatggattcgccagcaatcgtgagtctgttttttctttggtcgacagttcttgacttgtgtcaagcatgcgttgtctaacactctgaaccttacattagtggacgcaagccagagttggttttattcgaagagacaagaccaggcgcccacgcactgggccatcagtcctacaacggcgcggaaccgcaggcaagtggacaggtgctcgataagctaagtccgagcatgccatcgccacaggagctttggttgcaaaaggctcttggattttgggtggacgccatgatcacggttgagcgggatggtagcgagaagcaggagcagcatggcgtggaagtggcaatggagggatcacaaatggaggccagttggacgtcggccgcgtcaaatgactcgtatcgcttgtggatcaggacgcatgagagtctcatggcaatggtatcctcttcagccaacaacactgtcgcgcctgggagggatgagggtgatacaggtcgcgctgcggcatccgcaggcaccgttatagggctgcggtggcactttgatatggtggacaatcgctttcgtttgcaaaccttgacgtaggggtgcgcctggcctgtcataaaggaacttgaatcacaaaacgaagcacgctgtgtgcctgaaagtcctgtctttgtttttgcatcatatcacttcctacaaagaaactcggggggggggagggggaattcaggacctgtttcgcattctggctgctctgcggtagctcggagaaagtcggttcttgggtccaagaccctcacaaatgaagtgggcaagtgggatggaaaaaaaagttacccgcgcgcgcggccaacaaggtggcttgtgctgaacccaaaaaaaaaaagtgggtatgatttgcgaagaatctgggcgcgagaagaaggatcagctcggacaatcaaggaaaaatagcccacgcaagtttgtttgtacgcatctgcatgctatatacatgcgtgatacgtgagtatcgcggtgagcagatggctggggaggaggagaaagcgaaaaaaaaaggcaatatggagcggataggaaaggagccaggaacagggtgttcaagtgagcacttctcactccgactgatggggacagcactctaaacttgatcgcccctctgcgttcacaggacggttgcgggcacagtacagcagggggtgcatgcccatcgacgtggacccttttatattcccacagctcggcatagggtctcggatcctccgatctacgcttcaacctatggagaaggaggatgaccatctgcgcttggcacgacgtgagggtgaggaactactagcgaggaggtgaggcaaggcaggggaaagcgttggctgtggaagttagggtggtctcttggagtcaggcttccggagctgtgcggcaagcgagaaggcgggcggagtgctggatatggcagcagcgcaggctggagagcgaggggaagaacgagggagggtgagggagggtgagtgagggtcgttatcaaggcagaagcgcaagagcggggtgtgtaatttctcttgtctgcagcctcgctcaatctcctccacagatacgacgatatgtcgccagccagcggtatcagagcggtcgccctctggctggccgccctaatctgctcgctcgctcgctcgcaggcccaaaacaaataaatattttttcgcccgtctcccacactctgtcttttttttcctcttttcctctctgctccattcaccctcagtccttgtccatcctacccagcccccaccgccatgatctcttccgcatcagtctcccgcctggctcttgccaccggccgccgcaccgtccagcgcgctgccacccttgtgcctatggccagggctatcgcctctcacaactctgcccgcgccttctcggccaccgccaggtaactttacagcacacgcataaaaaaaaagtgtatcctccccgcgtgtatcctctcccaaccaacgaacaacggcccccttcccactcgacatcatggacacagtacagtcgcgtctatctgccatctcgatcagtggtagcgagggctagggctctgtctcgcgagagttgtgctttgcagcactaaaagcgatagcaaactatacgacacggcgaaaactgtcaggcgcatctcccgcgtccgtggcagcgacgtgtgtacgctgtatcttgttgctttacttcgtgaacagagggacctcaaaaaaatgcccttctcacaggctttggtagcggagacagcaggacctctgtgcatggcagttttcaggatggcattatggggaaatacgtcactcttcgggtttttttttcttcactttgcagcggatcacttatctttgatccgatggctggagcaacaccgacaagcctggatgcatcggatgggcaagatcgcgagctttccatggtccaggacggctacatagcagtgaaggtggtgcacatcagaaaaaaaaagtgagcggcgacacaatatcctcgactccccaacagaaattttgttttcaagattatcattcgacttgagatattctcacagcgttcttcgatccctttcactgctctttttatcaacgcccacggggcggcaaaagggaatcctcgctttattcttgcacgcctccatggcgtatactgcactacctctgccacccacagcaccctacgtaccgtctgatcagaaaaggaacctgctcccgagacccgccgaactcagctggctgggcttgatccacaacggaaagcgctccgatcgcactggttgctaatgcatttcctgtcttcaactatacgcaaatcagcgcaccccgccacatcttggctgcctcgtcagtctcgctcaagaccaacatggcccgcttctacagctccaagtgtaagttgcctgccttggtcgtcgactgcgtcgatctgtcctggtgctctctattttttttctttatctggaagccctcaatgagaaatcgacgcgctgccccaaccttaatgagacgaaggacgctcagtgcggacgattggacgattgggaaccacctggataaggaacatgggcagcactaccagaaaggctcgtttgacctgatcagcgactgatctatcgctctcttatcgctctgtgaacctttagcatacccttcgcacatcaccatcaacatgcctgctctctcgcccaccatgaccatgggcaacatcggaacctggcagaagaaggtcggcgattctgtcgcacctggcgatgtccttgttgagattgagactgacaaggcccagatggatttcgagtgccaggaggagggttacattgccaagatcttggccgactctggatccaaggaggtcaacatcaaccagcccattgccatcatggtcgagaacaaggaggacattgagaagtttgccgactttaccgttgccgacgccggtggtgctgctgccgcccccgccgctactgaggagaagaaggaggaggcccccaaggctgctgagacacccaaggctgaggctgaggcacccaagtcctccgacagcgccaacgccgccccctcgcgctctgatgctgatcgcatctttgccagccctctcgccaagaagattgccaacgagaagaacatctccctgagcgaactctcaggatctggaccccacggccgcattgtcaaggccgatgtcgagggatacactcctgctgccaaggctgctcccgccgccaaggctgcctctgcccccgctgccgcccccgccggcgcagcttacaccgatattcccctcaccaacatgcgtaagatcattgctcagcgtttgaccgagtccaagcagaacattcctcactactacgtcactgttgagtgcgagatggacaaggtgatgaagctgcgcgaggttctgaacaaggcttctgaggacaagtacaagctctctgtcaacgactttattgtcaaagcctctgctcttgccctcaaagccgttcctgaggccaacagctcctggatgaacgacaccatcagacaataccacaccgcagacatttgcgttgccacctcgacccctactggattgatcacgcccattgtcgccaacgccgagtccaagggtcttgccaccatctcgaaccaggtcaaagacttggctgctcgtgcccgtgccaacaagctcgctccccacgagtaccagggcggaaccttcaccatctcgaacatgggcatgtacggtatcaaacactttactgctatcatcaacccccctcagtcctgcatcttggctgtcggagctactgagaagcgtgttgttcctggtgaggatggcgaggtccgcaccgcgtcgatcatggccgtcaccttgagctctgaccaccgcactgttgacggagctgtcagcgcccagttcttgaacgccttcaagggatacctcgagaacccattgaagatgctgctctaaagtaggagagaagcgtcccgagatcaaaccagaaaaaaaacagcccatcatcctgctcccttcaccgtcgtctatagaagaaaaacaaaacaaaagtacgacgaatgcgaccttcccatccactttcccctcatctcaaggctttttctttcatcgccgttccgtaattaaccctgtatagcatatctcattaaaaacccaagtatgagccaaggtctcttcttcttcgctgctatttttttcttttttcatttcgcatgtaaacgcagctgccctagagtgatagaccaccatccaccaccagcacctaagaaggagatggaagaatcggtggatgagtctcgctgtgccacgcggtacgtatatttttttttccacacgttcttttgtaagatcgttgttacctgtcccgtgatgaatttcgcctgtgccagaaagagggccgcctcggccacatcctctggctgccctaatcgtcccaaagaggttctggccatgatctcctgtttccggacctctgtgatacctatgagagtggttaaccgcaagccaaggtcaagttgtgtcagtttgagattcaaccaaagtaactgtagaattattttttctagtgtgctcgaatgctagaagaagggagaggggggagggggaaaagcacatatcactctaccggaggtcatgtccgtgtcaatgtagcccggagcaatcacattgacggtgactcctcgagaacccagctccttggacaacgatttcgagaatcctacaaaagaaaagagccagtagaaaaaaatactccttcatggtaagctgaaattcgacatccatatgggtagctacgcgcgagaccttgcagggggggggggagggaccctggcatgttttaccaatgatcgcagatttggaggcgctgtacacggtctggcccatgttgccttggatcccgacgacgcttgagatattgatgatggcgccctttttgcgtcgcatcatccctttggcgacagccttgttgatccagatggtgcccatgagattggtggcgatcacactctcaatgtcctcggccttgtgcgccatcagcaacgagtccctggcgatgcctgcggaatggatcaggaaatcaatcggggccactttgctcagctcctgcaaaagccaaaagacaaaaaaaatatatatatgtgaatgaaaaggcaattttgtgtccctcccgatcaaaaacaagaaaggcggatcaaattcgtcacaagttcattaacggattaacagagaggggagacgggtcaagggctgcctctttttttcatggtatttggtatttggtattttggtacttgagcacagcgctttgtcaaccgttctccgttcaaaactagtccgtggatttttgtatgatgtttcaggagaaacgagcaagccataacgcgaagaaagggaagaaagggaagggggcgattgcctgctgtgttgcttttttttttctttaccttcattgtcagatcgacctgctcctgcttggacacatcacactggagtccgatgtgatttagagccgaggaagtagaaggagagatcgggcagagttccttctcaagaacatgatggatccgatccaggtcgcgtccaaggatgacaacacgcgagccctggctagcaaacagtttggccgttgcgagcccaatccctcgtgtgcccccgggtatcaaggtcagtgtgttggccagaggtctggactagaggtgtagatcaaggatggtcaagcgtcaataatgcggttcaggagagggaaagcattgagtggacgtgtgaagagacagagagagcacaggcgagtgtgaaactggaaatataaacacaggacatgggaggttctccatgtggtgtgggtctgcatatacacatggtgtgaatgccatttgcttggagttgaatcactttggaattgtcatggagttgaggagcttagcgcgtgtcaggaaaaaaaaaaaagaagggcggggcatggggagctgcctgcataagaacgaaggccgttgttgccaacacttgcctcgcctgcagcatcagtgaaagaacggcgaatccatgagagcacgggctggctgacgaagggcagtcgtcgtgtcatcagggacgaggacattgcgggcgtgttgatgacagtgtgtcgggggtcccttgttttttgttggtgatgaaccctctggctgcaagggaagggaggaggtggtccaaaggatcggcgaggatggcgggcacacggtcgaggggaatgaagagcaaggacgaccacagagaggtgagcgtgcaataaagggacaagtaggaagagagaggtccatggccatggctaggactgcattttcctcgtggaacggattcttcgtcactgagacccttgggattagctcggcctatcgaatgcacggatagccggctgccggggacggatttgtatgaaagggccaacacccgcgcgacgctttttttttttcttttttcattttcctgcctcgtagtctcgctctcgctcttctctttgctcgctccctcactccaacgcttgttctctttactttctctctgtcaaactctctgtctctcgctctctcgtacctcttgccatcttcactgcccattccctttctggattcattcctctcattccttcctccagtctcctcttttgtctttccgctctccctcgacccgctttgcccaaaacgcagacccccacgtcgcacaagctatggcctgccaaatcaccgtcgccctcctcgacacagccaaaacgctgaccgtccacaccacgccagcaacgatccttcgacagattgtccaggctgtctgcgagaagcaaagctacggcgatcaaggagcgtatggcctgaggtatgtcgctccttgcctgcacaactctatgccgtcgatccaaccaaacgattatttttctgtgcgacagtaacaaaaagaccctgcctaaccacgacgcacaccttacatgtactgtacatgctgcaaaaacaaaaaaaaaaaaggagcgggagtaccaccctcgatctgtccctctcggtccagtgtgccagcgttgctcctagcgcaaagttagagctgttcaagttacctcacacgacaacaggtaagccggttcgagtgctttttttaacctcgttctgattcctgacttgagcccgccaagtgtgcatccttcaactttaacaagaacttaatgcacagcggctccggattttgacaaagtgatttttttttttttttttttggctgatctttgccctcttgacacattttcgcctcctatcagcacccatgcttgccaccgttacgcttcaactcgaagatggccagagaatcttccagacccttgggagcacaatgacgctttgggatgtccttttaggagctgagcaaatatcgaacgggtagggacgctgacaaaagcaaacatacactgctgctaaagatatttgccacatttcggagcgctctcacaagaagactaacattcctctcccaatgaaacgaaagatccctaaatttgacgaggcgttcaggtacgccaccagcctctatcaagaacatgtttgcgctgcaacgccgactctcaagaacaaatcggacagcctcgcaggtgtacatgtttccggtcgtggttgccatggagcgtgaggtacatacgtccgttcatggtcgttctcttcctcctacttgcaccagctgactgactttttctgtgtatcaacacctttgtagtacgcatctttcaagagtttaaagtcaacgacactggaacaggcaggattggcatcaggaaacgccaccatacgagttaccatgcgacacaagagcagcgggatcgaaaagtacatggaagaacttgagccaggcaggtctttacaaaagggcagtgtagctcctacatcaccgacgcaaacacggccaacactcgccgaccgcacgaacgatgtacatgtggcaccggttcgcgtaccagagatccgtgggcgcattggatctatcttccgcaggactcgtgacggcgccccgagcggtccaccccaaaacggcggcagtcccagtaacaggtcggatggtggctcgccgagtcaaacacccacacaagatatcaattctgccatggtggaagctactcaggagattcgtcagcttcgtgaacaacaaactcaagaggctctaacggatcgcgtcaaaaggctctccaaatcagcggatggctcctcgtctgacaaggatagattcgtgcgcagcatgacgctgtacgaagagcctgatgagattctggtggcaagtccacggcttggcaccactcacaagacgccaccccttccgcgcaccgcttctcctctatcgaatactgtctcaactcagacgagcatgccgcaacagcaacagcaacagcagcagcaacaacttccgcaggatgatttagtgcgactgattgcccaacgcgtcagtcaacagctcaaactggcacagttgcgcggtgactctggactgaactaccactcgttgattgctcaagagattgtcaaggagcagcgcgcgggctccttacccatctccttgccgatctcgccagccgaaagccgaaagaattcggtggatgcaccgggctcacggacccatggaacctttgcccgttgagcttcggagggggaagagatcgctttgactatggcgagagaatgcataatgttatgccgcaatcaaaggtccgccgcctgttctcttgtaggcttgcaagaaatacccttttttacaaccacaataatggctccttgccctaccatgaccacgaggacgtgagaggatcgtgctacaataaatgctctcttgccatagtatgattttgatttttttttttacatgccaggtcattttctagtctctattcaaaaacaatgaactgagtagtcaagatcaagcccgatgagcatcctgcagcagcatgggttcctctcttggggggagtggtggagggggcactggacggctcccctggtttcgaagaggaggaggaggtggtggtggcacagccaaattgctgaccacatggtcctgattattcctatgcgtaggttcgcccacagctccctggccggcggctccagctcggacaggcttcatagcgttcccatagcccgcggtcgtccgctcatacttgttttgcttccgactcgccgcccaggcacggatctggtggcgtttgcggtaacagatcacggcgccgatagcaatggccacaaagatggagccaaccacgatcagaatgatctgccagacttccatgccgttgaggatcggtgggaggtcgggtcgaccggcggggatgaccacataaggaggcgagaccgcagaggacatgacctggtaggccatcaagccattgaagggcgcgttgtaatccagggccacctaatcgcaggaagaaaaaaaaaagggttaaagaggggatcatcacggttcatcagtcccaggattcttttttttcttctgtcttacctcattctgtctccagtcactacgcttgtcctcgaaacggtcattcttgtcgggtccaccgacgagggcgccatagatggtgtaggtctccttttcggggaacgtatcaatcgtgtcggcactgttgcctccagacgctggcgccgaatgtgggttgatcggtgagttcgggtggacgcctacaatgtacggtgtcttgagcgggttatcacccagcaaataattgatctgtcccagtgcaaacgatcggtagtcatcaatcttttcctgtgtcgatgctgcgacggcgactgctttgctgctgcctcctgatcctgttcctgatgtacctccactgttcgccatctggttcgccaacagatgaagcgcaaacgcagcattggccgccaccactgcagagtcatctcccgagttgccattgcagtaatacagtccgcccttggtgaacgaacaaggtttgggagcatgacgcgtcatgtccgcaaactgttctgaaagcccttgccatttcgcattgttgtccgcagtgccggccgtggcgccggccatcaaaatataaaccaaccccgtcttgtcgtcccaggtgatgggattaagttgaacgttgggcgtgttgagctgatccatgtatcgggaagcctttgttgcataagtcgaatcctttgtcagcttgtacatccatgcggccccccacgcaagctcatccacgaatccagacgacgcataacaacacgaggctgcgggcacaacggtctggtagacttgctggggcatagcggtttcggccaatcggaagagtgcgtccgcatgggattgcagtgtgctggcataggtcgcgtcgttgagtttgtcgcggtagagcatggcgcaggaggcaaaggcggcggccgcatcggccatgacatcggttcctggatgggtgttgttgacctgaaacgacggacggggcagtggaatgctggtatctggaccccagtagttgttgtcgacctcgctcaagccaacctaagtcacattacgttcgagagaagaaggaaagtgaggggatgtcaacatgatggacaggggtaaaaaaaaaacgtgcacagaccgagagcgcattcttcattcctctctcctcatccttcttttccgttacctgcacatagagggtgttattgttgggatgtgccttgatcagccagtccatgccccagcgaaccatccgatccagatacacggtctcgttggcgagttgatagccttcaaaaaactcgagtcctccccagcaggtttcggaaagtgaaaaggtgagtggaaagataaacttgagataatcgccagcgtcatagtagccctagagttgtttacaaaaagtaaccgagttatgaatgagagggggtttggggtcgggctgttccctccgtcgacgtgttgacggggcttgtatcgttgtttctgtttctggaatgttgcagtgcatgaatggtgtgcatttctcaaactgtcttacccctgacaggtccagtcccacatccttgccgtcatccatggcagagtcacggcgctacgaggaggagagagagggaacgagatacatgtcaaaacttgctgccgcgcatggaccttagttgtgataccacagcgactacataaaaaaaaagggtctttttttttctagacaatctcgctctagcggaattacattcttacccaagtaacgcgctgatccgcaggtagtttgcctgatcgctgagcctcgtaaaacgccaaagtatagtcaagaagcctaaggatagacatattaaggagaaaacccaaaccaaaaaaaacaaaaaagggtttaatgaagtgttttgacgcgaccgatccaagacctgtggaggatagcgcagagaggaggcatgggaggttttgtttccttacttgacatattcagggtctggaaaggatgggctatcaatagagtcccgaggttggtctggaaatgtcggtgctgaggcaaggggccatgttctgctgacgggtaacgtaggacgcactgtggacgagggagtaggggtgcccgcggaaggtgctgggtcctgagcgagcgcaccgatgcagacggacagcagagcgacgatgggccataatgacgcccgtgcagatttcattctttgcagggtcgcggaggaagtaatcgagaatgggatggagagttggaattgcaatcggaagaaaaaaaaggggggacgttgatggaaccgaggggcggatcaggagtgcagtaacggaagtgaagggggatgggctgtctctggtaatgggacttgagaactggacgatgacgagcagaggaatgagcaagagacaggcgagggacgaaaaagaaggcgcagagaaggaagtctaggaccaagagggacagggacagaagcaacaagaggcagagggagaaagtgagagcaagagacaggcgtcagggaacagcacgacgagagccacctgggggatggttgcgaggagatgcacacgaggaggagatgtgtgaggatgaacaggagacaagagaaaagataacgagcaacaagaaagaggaatatgccgatggcggctggctgctggcggagcgaaggaaggagcgaacgagggccgcgcgggtggagcggacaccgcaaagcccgaaaaatgtatttccgacggcctctcaaacagcgcgcatcgcacacgctgatttcgatcgcagacaagaaatgcccgcggctgtttcgaccctcgtcccctgcagagccagtgccctgtgtgcctggagtctgtggacgagtgtgtgccttgtgtgtctttgaagccactgcagcgcctgtagacatccactctgctgtctctgcgccctcggcgaatttcaccgcagaaggaccggcagtgggctgttcatcgagctgtcttggccttggactccaatgggatgcgaaacaagtgtccaacgccctcgtaactgctcactttggccatctcggcataatgtatagccacaccccttgcgcgtccgagagtaagaatagcatcattattttgggcacacacaatcatcacgattggggaaaaaatagcagcgacactcgacatgcaaccgcgtcacccttattttgttcttcagcccgcccgcctgttgctgcgaattccggtgtcagcttctctccttcagcgactaggggacttgcactttgccaggcttgacaccgccataaggatcagatgtctcagattcggtgagcatttttcatggcgcaatgccgcacactgtttatcaaaattcagctggcgtatcgtgaggcagccactcaaaacggaagaacatctcatcctctgtgtgtgcaatgcagtgaaaggatgaacaaccctgaaatagagaaggcagtgctgtgctatcgaaccacgcatacttgcattctgcacgtgcgtgtacctgatagagaagtgccatggctccattcgaagcttgaccagattttcgtttcgtgaggatgttgcagactgctgctgtacacaattcggcacagttgaatggtactacgaaaaaggaagaaagaaaaaaacaaaggaacggaagtgaagaggcagaagctaacgatgacgatcaaggtggaggagaaagtacaaaccctgtgggtactgcacatggtcaatgcgagagaatctatgctatgcaaggccgtaagagcgggtggttgcaggaggtggtatgtggccgtgtacaggagcccatgcgttcccactattatacgcgatctttcctgactggccatgtggtgttaaggttcaattacaatacgctaaagcctcttcgattggccaggttcagtggaaggtccatatgccctctaatggaccgtggtacaatacgtgaagtcagcattcaacgtgcgttccactttgaagggcgccgcgcagctgcttgttttagccacaggtaaactggtagacttctgggagcagtgtcagcaagcctggcttccagcttgggtatatggtacctgctttgagtcaagaaaatgtgctaaggattggggaagagtgcctggatccactgcgtcatgtcactcaggtacgtagtcagcatagtggcctggcgagttcaagctgactacaagggcctgtagtcacaactcacaggcaacaacttctactttacgttacggcgtagtggctggtgtttgggtataggagtgctatatgccaaggctgtacctcctctgctgtacgccgatacaggtggcgagggtcgtgtagtgtgcctgtggtaccgtgagcgaggctcaggaaccccgtaccaatgttgtctcggtgcacttgagaaaaaaagaacgagatgattttttttttcatctgtttggtgtccacccccagcctgcccacgcccagttcactactttcggtgccccctgctctcctgctcactctcactctcactctctcccactcactcactctctctgtcgctctctttttctcttttttgttttcttattttgttcttttgcccgctccctcttcctctgccccatcccccttctctctgcccacatccctctttcctcccagggtcgagcatctgtccgcatccgactcctctctgtcctgctcgcgtcgttccttactcccctcactgcccctgcctggcctgcgcactgggaattcacttgactcttccctgcgtccactcctcccattcccatctcgcttcaccctccgacgcccagttgctctcacatcgtgtccgctgctcgcttcacagcccgtcttctctgttcgccccgcccgctgcatgcaactcgccaccgtctcgtctctcctcctcacgcaacccattcaaagcttgatgtcccccaactgaacgttcatctctctattttcaccccttccgcaacatccgttggccacacccccttttcccttgcaggacgcaccctccctctctctcgagacacttcccaacgaacaccggtttgctagagagcctcgagcctattagctccttcttcgactatgggtgctcattggaaacgtgagaaggtgcaggaccacaagttcgactttatcaacgtcgacgactttatagacaactcgtgctggcgccagtttcgctacatgcttgtgttcgcagccatcatccgaggcattctcgtctactgctccgatattttcaccgccgtcaatttgctcacgaatcagagttcctcgaccttcgtcgacaggaaaggcgtagacctggcaggaatcaccaagctgcctctggactacttccggtacatcttcacgggatgtatcatctttggatttctgctgctcgcgctcgagatgcgacgagcaaagggaatcgtcgcctccaaggatatctcctacgccttcacgtcgcagattgccagtcggtactacactgtgcgttcctacccccattattgcctctttgcccagattcacaactccaagaagactatcgatgaagtggcctttttctgcttcttcacctttcgaagtaggtttcataagcgtgcagtgtttggcctcgggcaaaaattggcgccccagtaactgacatgctttattatcacccatatccctttttttcaaacctcgcagactggaagcgacttattttggcagatgctccccgccagctcatcaacgcgtgcattcttttccagactttcaagccccataaggacgagctctttaattgggacaagatttttgacaagaatgtttacaagatgatctctatcagcgccatgattttcacggtcgtgatgtgcatcatgtcgctgcttatgcttgtcgcggccgttgttctttacatccccttggtcagtcatatccaaggcaacctcaaagagtattgctgccacaagattgacaaacggtaaggccatgcgttgtaacgggcgtcatatgttctgatgaatgtttctaaactcagtaagctttttttttgacacgatagcattgacgagctcatccgcaaaaacacaaagactagggctaatgcagctctcagcggcaagagcaaagacattgcaatgagcaatctgaaacagcctacacttcctcagctggacttgcttgaggcagggcccacactgccagcccagacgcccaggaacgcgtatgcccaggcgcaatcaccgtatcctcgcaacgccaatgtcaacaatggacagcaaggctatggatactcgcaaggaatgtacaacaaccctagtccccagcaacctggatacacgcaaaactactccaaggacgactacttccaggccaagcctcttcagggcggtcagtctcaacgcgatcccacagccttcgatccgtatgcagagtctgcgttcacgaccgaggatgcctatgacgcttacaactcgaaccaggaccagcagcacctgcagcagaagccccgacacgacatgtatggcgattactatggtggcagcaacgttggttcgcagcagcaacgacaggcgccagccccacgaacccggcgctttgatgactacccgtcgcagcagcgatcagcatcgccctcccagcatggatctgaccttgatagcaacgtcaatggcagcagtggacatggctatggcagcaaccagggctatggaaacgagtactatccgtccagtggccagcaggcagggtccgtcatcggctactcgtccccgcctccacgtcctcgtcgaaatgacacggcgcagacgagggggccacctcgcgccggctttatgtagccaggactgtatgttattcagttgttgtaatagattgatggacgtgtagtcgtggtgcctgtggtcgtgtcaaaggcgtaggagcgtgggcggctgcgagtggctagccaataggctctcgcaatgaaaataggtttctgagggcattggtgggagagagcaaaaataccaactttgattttcttgctgttcctcatcagcctgcattcaacgcctctgtctcttcttttctttcttcttcttccctctccttgtcctcttcctcgtcctcgtcctcttcttctccctcctgttcccgcctctccactcttccgaagcagcatcctccccactcctgtgcctctccgccatcctttctctctaacgaatgccctctctctcgcgccacgtcctcttcttgtcgttgtcgcatcccgcgtgtcaggcagttgcccgttcctgattccttcttcgtcttccctgtacctccattggtcctttccacgcagacaaagaggtcgcgtccttccacgttcgtcatagaaaagaaatacgctcagcccattcaaagccgtagaatgtcgttgacactggtgctgtcgagcatcctgatgggcggccttttgtgcgtaagtcagcctgctttggacaacgcatctggcattggccctcactgcaccatggtgtcatgtcctcaccaatcgtcactctgttactgatcccatatccgcgtctttgacaggccttctccgtgctctatttattaagccccaatccgagaccagccacagagcctgaacagtgttatcaggatcatactcacctcgaagcgctgatcaaggaggaacaggagcatgaacagagactcaagaaccaccaggcctcctcaccaaccgccgccggaaccttgaacaagaaaaagaaaaaggtagcaggtggtgccacgcgatctgaaaagtacaaggcgcaactgccgcgtttgccaaggactgcggatgagggtgcgccagcaaagtcgctgtcggtcgttgtgcctgcctataatgaatccgagcgacttccgatcatgatgaaggagacactcgactttttgaaggcaaggtcggaaagtgaccctcagttcacgtacgagatcttgatcgtggatgatggctctcaggactcaactgtcagagtcgcgttggagattgctcagcaggaacgtaacagcgatattcgtgtcctgagttttgagaagaatcgaggcaaaggaggcgccgtcgcccaggtacattttttttttttagctcaaatgtccacgacctcgttcccgtcgaaaggagaactcgctaactcacactacacatcacttctagggaatgcaattcacccgcggcaagtatatcctcatggttgacgccgatggagcaacgcgattctcggatttggatcagttggaggccaagcttaaggaggttgaacaggatggctacggggtcgctgtaggctcgagagcgcatttggtcaagacagatgcagtcgtgaagcgctcgttcatccgcaacttcttgatgtattcgttccacaaggttgtctatgtgctcggcatccgagggatcgaggacactcagtgtggattcaaactgtttacgcgcgagaccgccaaggctatcttccccaatatgcatgtcgaaggctgggtctttgacattgaggttctgatgattgctcaacggctcgggattcccattgccgaggttcccgtggcatggcaggaaatcgatggatccaaggtttcgcttatgaccgactcgattcaaatggctctggacctcttgattatcaggatgaactatatcctgggcgtttggaccactccgtcgatcaagaggacgaaatagggcgccgcattgtgtaacgaaacaccgaccacgaccacctctcactgtcggcagcaacactaccatcatagaccacaatgggtatttccagaaggtcttgcattaaaacttcagagctctttttcgtttgttccaagaggaaaaaccattgtcgcatatgtttgagcatcaaagtactcggatgctgaactccccatgctttgtgcgacagattcctggccaggtcttttgctgtctttcattatcccggcacatgaacggtcaaccaagatgtaaagttttatgagatggaaatatgggtacaataaggaggtaactagcaatgaacaagaagggagatgaaagagatgacattgaaggcaaggggagcgatgtgctgtgctttaaaccaaaagcagcgcattcacgcaaccgtccagctcggggttgttggtgatctgggcgtatttaccccaaacaaccttgcctcctgtcgtgaccaatcccaactctgaaacgttgacctcaatgaccgtacccttcgtcaagacacccagctgtgtgtacaaaggactctgagggttcttcttgacgccaatgatgggcaggcagaacgtggccttgagttctgggtgggtaacatgagccttcttgtaacggagggccgaggggcgaatgaaccgctcgtactttgggggcttacgggtgaatccgtcaccgacaaacgttgccttggtgaccattctcttccatgacttggccttggtctttccagagcggaggaccttgaacatctcgtcctcagcaataccacggaccttgggcagaggcacattccactttccggccttctccttgcgcttctgcttgatcatgttgctcagcaccttggcgcgctgttgaccctcacgatccaaaagataaccgggaacagcaccctcgggaacagcctcggtatccttctgcttggcgttcttctcctcatgctgcttgatgctgttgcatagatatcgccgcgtcagaagataacatggaagaaaagaaaaggttaggatctgatgacgtgaaatccacagtactgtcctctgctaattctgacggtgctgcgggagactatccaggtcattttcttggttgtcaccacccgcagtatccagggtccctgcatgtaaatttctggcttcctgaacatccacgtcagcgcatcagcaatgagtcccgaaaatgctgttgtaagccatatcctcgtcaagtcctgcatgctgagctgtagaggtgcgtcctgcaacaatttcaagtggttctccgtgtcgatatcatgagcccgtaatgaaaatacgtacgtcttcttcatctggatcttctcagagtgtctcttcttgttgtacatcttggccctcagaccagtgaccttctgtgcaaactgggagtccttgtggacctgacgggcctctctcttacgcctacaaggtgaagatggtaaagatatgagtatgagaaatacgtacaagcgcctcatatcattcttaagtgtctctgcacggcgggctacttacttgcgctcagcgaaatcgagcctgcgaccatgtcgcttaatggattcttcgatatactcgttctgaggctattgggcggaaagaaagagtcgtgcaaggatgacaaggattagacgagatccagaacaagacggatgttgtaaaaaaaaaaagcttggtagcgatgttatgctgcgatgggagactgttgaaagcaggatgacgagtcaatctcaacagcgagacagtgggcacaagctggcggtgctaggagtgcatatggaggtgtgcaaagggtgaacacaaggggcaggggcgctttaccatggtggaatgagggtgatggcgaaaggagggaattaatgcagctcagtgcaggggacgctttagtgaagaaaaaaaaaaaaaaaaaagaaaaaactgtggcttgtgcgatgaaaacatcgcaaagcgggcgccgacgacgacgagcacgaaaaaaacgtgatttacggtcgcaatgagaaaatgcataaatatcgatcaagggtctctcttggtcttgttctttttccttcttgttcctttacctttgtccaaccttccctccccatcataaagcaaacatgtctgtccctactgccaacttggcctccttcaagatccccgccgtcaccaatgagcccatggtatgtctgcataacctcattgcccattgccactgcccattgccttccgcccgtattcttttacaatcgccaccaagtcaaacgtttcattttgctaaccatggtctcttgtcttctcccccctactgctaaccaggcaacctatgcgcccaactcggctgagcgcgctgcccttcaggctgccttgaaggagctccgtgcccaggctcctctcgatatcccttgcattgtcaacggaaaggaggtacgcgaatgcgcatccttgccttgtgtcttaaactacaggctcgaagcttagagtctttttcagcagctaaccataagaaacatggttctttctgccttattcctacccttcaggtccgcactggaatcatggagaagcaggtcatgccccatgagcacaagaccgttctctgcaactaccacaacgctgacgaggcccttgtcgctcaggccatcgacggtgctttggccgccaagcaggactgggagaacacgcccttcaacgaccgtgctgctatcttcttgaaggccgctgaccttgctgccaccaagtacaggtatgagagtctcctgcttttaatctcttctattgccctccccaactttttctttctatttggttcgaaaagtgctctgtgcacccctaccacgacccacagacgtcttttttgggatggtgaagcaatgactcctcttttagagtcgtttttagtgcgaggacgtgggtcatttcttttaacgtttgtgcgatctgagtgtatgctgagccctgttgtgggtgggaaattttgggggcttcttcccgcgctcaggtcgtacgagcaagtgcggggagggcaccttgtctatttttttttttcgtacctgagcgcaccaatgcacgtcatatggtctttttttttggcgtcttgaccaagacaaaatactgcatcgcgatggtctttgtggattcacaacccccattcttggtttttcttgtcgatctggtgttgggtccccgggcagtgtctcatccaaaagcgtgcccctcagtttgttggccttgaaattattttggccgtttctgccaatgacgccacttaaaggcccgactttttgattttctatgacccataacttgttcctgctatgacccataattcacttcaaccgttgcagctcctccgcaactacacccgatatccatcgacttgtaccctgcacgctcatactctcaaacccctctactcctccgctgcggactcgaactctgcacaccatgccaccccaacattgccccagaagggtacccatttgaactcaatgtattgacgtcgtgcatattgcttggtacctgcttttagatacaagatcatggctgccaccatgttgggtcagggaaagaacgcctggcaggccgagatcgacgccgccgctgagatgattgatttctggcgcttcggtgtcaagttcgctgaggagctctatgctgtccagcccccccagaacagctctggaacctggaaccgcaccgagtaccgtcccttggagggcttcgtctttgcggtctcgcccttcaacttcactgccatcggtggtaacttggctggtgctcccgtcttgatgggcaacgtctgcgtctggaagcccgcccccgctgccaccctcgcttcgtacgtcgtctacgagatcatgcgcgaggctggtctccccgccggtgtcatccagttcatccccggtcccgctcccgaggttgtcggccaggtcttgaagcaccccgagtttgctgccctccacttcactggttccacccacgtcttccgcaagctctggaaggacattggaaacaacattgagaactacaagtcttacccccgcattgtcggagagactggaggcaagaacttccacatggtccacaagaccggcaacgtcacctcggtcgtcaacaacaccatccgtgcctccttcgagtaccagggacagaagtgctccgcttgctctcgctgctacttccccgacaacctctggcccgagatcaaggctggcctcattgctgctcacagcaagattgaggtcggtggtgttgaggagttcaagaacttttctggtcccgttatcaaccagttctcgttcgacaagatcaagagctacattgactgggccaagaccgatgctgagtctgagatcattgccggaggcacctacgacgactctgttggttactacattcagcccaccatcattgtcaccaccaaccccaagtctcgcaccatgacggaggagatctttggacctatcgtcaccatctacgtctacaaggctgaggagtacgagagcaccttggagttggttgccaactcgtcggcttatgccttgaccggtgctttgttctctcaggaccgctacgccaccgtcttgggcgccaacaagctccgcaacgctgctggaaacttctacatcaacgacaagtgcactggtgccgttgttggtcagcagcccttcggtggtggacgcgcttccggcaccaacgataaggctggttccgctgccatcctctcccgctttgtctccccccgctcgatcaaggagtcctttgtcgacttggagaactttatctacccctccaacttggtttaagtttctcattcaacctttgaacacgacaaagggcctgtattttttttgatcctgcatataacttgaccattccgcatctcttgagtcaagctcattgacaaataaacgacttagaagagacataacaagatgttcctacacagacgatggcgaatgagaatgtgtttgggtgccctgtctcatgtatctatctctcgtccaacaggaaggaaaacagagctacagacgggctaatatggtagcatcttggtcttggatccagctgcagacatgtcctgataccagttgcgggttctccaagtgcactgcatgcgatccctcgacttttttgatggtgagccgtgtgttgctgaaccattccttgttctcacttttcactgcagcacagttttacattttcatacggcaagaagaaacaggtgttatcgccatgcgcttttgaaattgcctccagtagtattccccgccgcgggtcctttgaggacacttttttactcacactgaccctctgtggccatcactgcaaggacaggactggtgatgcggcacaggaacgcacgagcgtagacgctggagatggtctgcgcgggctgaatagtcaggatgcggtcggtgctccaggtccacccttggagaggaggggtggtgttgtggggatccctggggtctgagatctctacaggcctcaagccacgggagacgaggatcctggccgagccacgattgagttcaaagtcgcctcctttgctcctggcgtcgcaggcggattcgagggtgggatgaaaggccatgcgtttgtggacgagttttcgtttctgctccatgtgtgtgagcaagcgtcgaggctcatcctcgacagaccgcacccaggggccgagattgtccaggaggatgcagagtactactctatattgcagaggaagggggggggaccggcggtagatggcatggaaagggagcgttagcagacgcgactagctcgtcaatcggaggggctgacaaacacaatctgagacaagatagagctggaggtggatagaggtgcgcactgtaccgcgattcatagagtcccgcgtagagggtgcagacagctccgcccatggaatgaccgatcagggcgtgcttgtgccactggagttgttctgtgacctggtcgaggtcttcgacaaatcgccagaggttgtagtcctccgtctgacggtgggaagacatgccgtgtcctgcgagatccagtgctaggatctcaagcggctcagggcctagctgctgaaacatgaggctacgtacagacaaatggctatgtgtgattagaactggacctgggtgtttctcagacgatcgatcgttctagcaacagcgaaacaaagaggtgggtgggggtgtctttacggcgccagtctagaaagtcatgaacgaggaaaaaaaaaaaaagaacggtaacagggggactgagtgtctgtgcaaggggcttcaagttccagtggcatcttgttgaggaaacacacggacaagggcgacattgcgcagacatgctttacaggtcgaaggagcctgcattgtccaggtgaccatggagggccaggaaccggcgggagtctcttgccggggcggtggtcgtggctgtggtccagtgctttgcagccaggacgatgccgttgcgaagttggaatgtgcgttcctgcgcagttgggatggaatgcatgggcgggtatgtgtcagggtgaaagagggagaggaggtgtgaggagcagggagggtgcgacaggtgggcctggtcttcacgcacgcgcgtgcttacccagagaagataacagaataacgcatctgcatgcgatgccccaatgccgatgcctgtagactggccttttttcctctttcctgtgccactagcccccgttcgatccagcgaagaaggccatgagtgaatacacgcggcgagtatggggtctatggcgacagcgacagcgacaactacagcagcagcagcggctgcgtctggtatcactcccacaccgcccacagaagctcgtttccaaatgcggggtcgttctgttgaatccaaatcaaaaaaagacactcgtggctctcgctgtccgccccagcacgtcaaattatgagattgcgcaaatggctctcggcacgattttcccatcaggccaacagacttttacgaggccatggagtaccacttgcgatcctgtgctcctggatcggatgtccgtctgctgcacgacagatggggtcagggggatgctggctgctggctgctcagtccaacggaggcgcagaggagagggcgatccagacgctgtcctgcgggatcccgtctcctatagttgatagcgaatcgttgccataaatgatcgtgtcgcgaaacaatataaaaaatgtttccttttccttctgttctccttttcttttctttttctgtttccctttgtctcctcacatcacctctccccatcacctcgctcccccgcccattccttcctgcaatgtctgccgtcaccaacacaaccgcccgcgtgcagaagctgcgcgccctcatgcaggagcacaacgtcaccgccttgtgagtgcacacaactcggcaatccgcttccgctgcagccgcgactgcagacgagtgcacaaagaatccaaaccaacgctcagttcgcgcgctcaccatgaccttcttgtcctcctttttttttctcacgcttcatgccactcgtgtgatgcagcgtcgttccttccgaggatgctcaccaggtaattcaacactgaccatcacccgaattcaactcgaccctgtgcgcactcatagacagccttgtctttcttctgaagactaacctgataagcctatgtttatcgtgtgccttcatccctgtagagtgagtacgttgctgagtgcgacgagcgccgtagctacatctctggattcactggctctgcaggattggccgtcatctctctcgagtctgccgctctcttcacggacggccgctacttccttcaggcttcgcagcagctggactcaaactggaccctgatgaagtccggccttccagaggtgcccacctggcaggagtaccttgttaaggtaaacaccgagatgtcatctgcatccatccgcatgcaccttcaactatgcagatcgttcgctatgctctggtcttgcccctgaccttgactctttgtcggattagaacctgcctgctggttcccgaattggtattgatcccaatgttttcaccgcaagtaagttgactgcctgtgttacgtgagcgggcctgggagacatgtcgcatcattccgtgcgtctagtgggccatgcgccctttcttcgtgtgttgccggtgctaatcagtcctcgcctgcggcatccgctcctggtgcttcctcttcttctctgacagccgatgcctacaagcttgaagccgacctggccaaggttggatcctccctggtccccaccaccgccaacctggtggatctcatctgggaaggtcgccctgcccgccccgccagcaagctcatgacgctttcaaccaagaccaccggccgcactcacaccgagaagatccagcagctgcgcaaggatctggagaagaagggcgttgcaggattcgttgtctctggtctagatgagatcgcctggctcttcaaccttcgtggttcagatgtccactgcaaccccgtcttcttctcgtacgccattgtcacccccagctatgtcaacctctatcttcaggaaaagtctgtctcgcccgaggcgaaggagcatctcggacccgaggtcaccatccgcccttatgagactatctttgatgacttgcgtgccatggcatcgtctctcaaggagagcaatcaaaagatgcttcttggatcccgcaccaacctcgccatggctgtcgcccttggcaaggaaaacactgtggaggctcgttcccctgtcactgatgccaaggctatcaagaacgaaaccgagtgcgagggcatgcgccagtgccaccttcgcgactctgctgccctcatcaactactttgcctggctcgaagaccagctggcccagggcaaggagctggacgaggcggatggtgctgagcgccttgaacagttcagagcgtaagtgattgaagtgtctgtttcacgatagcgcgtgcacgctgttatgtcacacatggtaccaacccttttcggaaatcttatttcatcgtctctatagtgctcagtcgggatttgtcggtctttcgttcgacactatctcttcgactggccccaacggcgccatcatccattacaaacccgagaagcccaacgctgcacgcatcaaccctgatctcgtgtacttgtgcgactctggcggacagtacattgacgggaccactgacgtgacccgcaccctgcacttcaagacccccaacgcctttgagaagcgctgcttcactcgcgttcttcagggacacatcgccatcgactctgcagtgttccccgatggcacctctggatacctgctcgacattttggcccgccgtgccctgtgggccgatggtcttgatttccgtcacggaactggccacggtgtcggcgcctttttgaacgtccacgagggcccccatggatgtggaacgcgtattgcctacaacgacatccccttggtccccggcatgactctgacgaacgagcccggatactacgaggatggcaagtttggaatccgcattgagaacgtcatgctggtccgcaaggtcgatacccctaacaactttggcggccgtaactactatggctttgagcacgtcaccttggttcccatgcagctcaagatgattgaccgttctctgttgacccatgttgagattgagtggatcaatgcctaccacgcagagtgcctggcgaaggtctcgcctttcctggagaaggactcgctcggtctcaagtggcttcagcgtgaggctgtttctctttaagcgagacagatcaccgagtgacaggagcaagagcgcaggagagtatgacaaaagcgaaaggcaagaggcaagagccaggacgaaatcaaagaattgaagtgtggtttaggaccgtcgagcataggcttgtatatagagtgtcagcaagagcacagttttgtatcatacacattggatatcgcgctaccagcgtggtgttgcccttgcattgatcgtatcaaccacaggatgattgtcgagcagaggggagcttggtctaggacgctttatcagactttttttctcattcaccgtccgtctatttccatgctacttgttaagccataatggctttccagcctgcctccactcttgtctccacttgctaccttacgcgtaccaaccaccaccctataggtctcctcacgagctataatgagaaccgagcactcaccaattgcctgtgaatatccacacgcaaactactttagccatgcgcatgcctcaaactatcccgtcagcgagtcggcgggatctgaattcttagtcgaggcacccagttctcacatcctcaagtcgagggttgaggatgaaacggctactgccactatcgaggaccacatcggcaaaggcgtcagatggtctccgcagttgatggcactcagtcagaacatgcatttgtatagtcaacctgtcttcggcccctctcgaccgtcccacactcttgctggtgagactgatgataaacctcctgcaagcacgtcggttgaggacgctgcttctgcgctaccatgttcgtctagtgtgagcaccatcgcccgcaaagatcacacggcatccgaccaccagttgactagagctgatgagagtgcggatgaggatataccgctgcccccgcgcgcgacagcggcggtagtgagcaagagctctcaaccggagagggacgctgtggttcaggatgcattccagcagttgcaggtggctttaccgctcaacctgtggcacccttcaccacacaaccaggaccaggcaaatgcacattcacatcgcggcctgcagcgtcatcacacgacccacagggatcggtcatcaccaccgcctcttgcggctcgagagcacgttctgtggacccctagagcgcccgtagggcttgcaagctgtaacccgtctgagatcccatgctcggcaggtcatcaggttcacccggatgttcatcctggccacattctaggcgtcaagaagcctgtgcatacaaagagacatgcgctctatgacactccattctatggcatagaaaatgtagagatcacttcgagtcgatatgatcagatgtctaggtctgaaacgtctgagaccctagattttggtttggaggctcaagtcggtcaatgcaattctttgcgggaccatcgagagcatatctgggccaccgcgcatgaggatgaatatggatcacagacagatggaaagagcgacggcaggagcgacggcgagagcagttggactgtgctgttgtctcgggcgcgacagaagcgagtgcagagatgggtgcccttgtcgacggctgtgagaccgactttggatcgcggctccggggtgggatcgggagctggatcctctttgagtggttcgtacgaccttgcgcacgggaccgagagctcgtccttgtcgggctttgtggacgagagagatgtggcggcgacgcgatccatcaagcctgtgagccaaggtgtgtatggtccagattcttttgtagagtccctccaaacccccgaagagagcgatgtccggcagccatggaggcggcgttgtgctctgaaggcgcgtcggcagtggaggtcatggctgattttggtgatggtgttggccatcgttattacactggccgtgatcctcacacagaaaagggtcttgcagcaatcaccaccgctggagggagacgttggggagaacacggacgtgggtggagagactgtggaggaccatcgaggagggatggcggcgacgcggaccagcgttgtgacgcacacagcgccagcgagctcggcagcctcacgtagaccctctggcagcacgacgcgaagcgcgcgtccaacagtcctctaaacaagcgcgtactttgaaacatggtgtatttcgtgtataaaccccctcgagctgggcgtatttttggttgcattcacatcttttttgtcatgaaccaattcgcgcaatccacccgctccaccatcaacaccatcaaggcccatgctctcctctcaaaggcactcaccaatgaccccaagcccaccccaggctacctcttcccagacattgctcgtaatgctccatcggcattagcctttgcctcggctcaagctttttttttatccctcatggcgtgtgtcgttctaaccaccaacaccgaccacgttcacgcccacgataggtctcacgcactctaccgcgacctgcttcatcgtcctgacacagcttcttaaagcgatcacaccctctggacacgtagggtcttcgtctgtgacctcgacgcatgctcagtcgtttgtgggtagtgctgctgcgggagggcctggatcctctggagcctcgtctgcgtacacatcctcgcctcatgtgctgctgaaggctctgaagatcctccgtcagctggcccagagtggctcagtagagttccggacgttgttggccaggcgcgggaaggcgcttttggtcgagatggttggatataaaggcccttgggacgaggtgcatggggatcggtataatgagaacgttcgcaccgtggccgaggtaagtgaggggacacaggacgagccaaaaaaaaatggagctgtttgctgtcacttttaaaaacgataacggaagaactgagatgacggtgcctcgcttgtataatttttctttccacttcttgttggataggacctgatagagtatatgcatgcgaacccagttctggagcaggaggagcaggatggggtgattgacttgacggataaggaggctgcggttttgaagagtagcacacaggatcttcaggggtttggtcacccaggtatgctcaagaaacttttgcccacagcttttgctggatacgttttttttacaaaaaaaaaaaaaaaaggccccgctgaggtagaggacgcgcatgttcatggacaattgatctcacgtatcgctcttgttttggattgctgtttggaatagactacgaggattcggacagcgaggaggacgcatcgcggagtaaggcgcgggtgaaaagtaagaaggcaagaaaggatcaggtagacagagccacgccgccactgccgggattcggcaatccggcgtttgaaaaggataacccgcaagcaggtaggattcgcgaaagggacactgttgggttacttgaaacgtacagtggacgcgacatacgggctgagcacgttcttcgtgtaaatttttttgtcggtacgcatcattccatagagccgaccttgatgtcgcggctcgtagatcggattcaagagatgacagcaccgccaccacctgtggcgatgcgcgaggcttatagaaagcaggaacagcggcgacaaaagctttttgtgggtgaatacagcatgcgcgacgatgcctcgggcacatacggccgattcaaaggcgagcccatctcactggtgggcaccaaccccttcaaacggacgacgagaactcaggggttggccgcaggaggttgggctgacaagagcgggagccggcgtgacgctgcatatacgcgaatgtttccactgtcgcgacaaggaacagggacgattcagtttcggaacgcgacatcatcagctgtgtacgagttggcacagcaggtgcaaccaggtgtagtgcgaactagattacagtcgtcagattccgatgtccgatctcgtggagttggattgttgtcggtatggggcacagcgaaggatatttgcgacattgttgctgaaggagtgatgaaggactcgtcgatggcagatgtcaaatcgcaggaagggggggcgatgatgatgcagggcttggatcagactgtgccgaccatgacgggtctagtgcgagatatcaccgactggatcgagcaagaggactgggagagacgactggtaagcccatggcgttggatatctagttcagtcctggctactgttgtttcgaagggatggaaataactgttggtttttttaacacctgtgcccgtcgttagaggtacctggttgtcctggatgctttgcttgcctgtccagagactaaaggagagctccttgactgctcggcaatgccagttctcttgaagacgctagagagctccaggtgtcaaggggcgcctcagaggtctattcgggatcttgctcatcacgtaagtacaagtttttttcttgttatttttctttcgcgccgcagcgtgaatggtctaccgagcatcgcactgactagaccgacgcaatagcttttagaatactccaagagggctcttcacagcaaacccaggtctggtccgtctacgttagcgcccggtggcgacggtgatagccgtgcagatcctggaactcggctggacgtgatgctcttggacttggacctgggagcgaaataaaaattgaacccatcccctctgtcgctcaaagttttttctagcgctgtcagtgctgggacaaaatctgaggctcgtaaccaccctgaggaaaaatcattcagtcttgttttctcaggctgggaccaaactcgaccagaagtgcgttgccttcattttttttgcgtgatgaaattttaagtcgaaaattagctgcagaattcattctttgcatcttacagaggttgaccttgtaccatgtcggttaaatcctctgtgcctgaaatgttgggcacaatcataaacaacagcgccttctctctacccggaagcttgcgctcatcgtcccggcccccttcattcccccttcattcgtccatggtacaaggtcaacctctgtaagatgcaaagaatgaagttctgcagctaattttcgacttgagatttcatcgcgcaaaaaaaaaatgaaggcaacgcacttttggtcgagtttggtcccagcctgagaagaaagacttgtgaaataattgccttttatggctattttcgtggtacacgtttcacgtgatttcgactcagggtggtgacgagcctacatagggaacggcgagattttgaaatccccagcccttcctgaggtgaaaaatcgtttgagcgacataagggatggcctcaagacctcgggactgctttttaaaaaatggtggcgagctcagctttgaagaccgttttgccatcgatgcaatcccaaccatgccctgcgtcctctcgtcaacgataccctgctcatcccctctaccctaattccataatgcgagccataatcccatccgtctcagttaaaggtagccgccatggaagaacagcctgctgcttgctgcactctcgataagccaaaagtgatccttctgctgtcgaatgcaaccgcgagattccacctggtcctatttcactcaactcgtcgccttttctttgttcgctcaggattccaatatatgctggcgtgcctcgggaagataggagacgacgttgtaatagaagcccggccggatcggctcacgttctcgacactgaatatcacccgcaccgcgttcgcggacatcacgttcacgcgctcttttttcgaaagctaccatctggacacgagcgctgaggctattcaagacgatgcaacaggtccgtttctgcgatgctctgtgcttgcaaaggtaacgaaagagggattttctggatgcatgttttttttttcgggagaatatccactggatgcttactgtcgcgattttttttttttttggatccacaggcactggtctcggcgtgcaaaatacgcggcaatgtcacggaaaaggttgaaaagtgctgtcttttcatgaatgcggcagagggcgtgggagagaactgccgccttacgatcgagatcatttttaagcatggtcagtgatgctactaaacgccaatagtgattgagcagagaacctagaggtattttcaactgacgtgatacaccttgctttgatctatataggtttcatcaagatccacaggctgctgtacgagtcgtgctcggaggcgccgcagattatcgactcgatccagtcatgtccgagttcatggagattgccgccagcggcattgatggggctacctgagaatttttcagcaaaagcagaggaaatcaccatgagctgttctcaggagggcatcgcttttaaaacgtgcagtgatccaggcgaagaggactcaggtgagtctgctctcgacgtgctagggcgtggactgacctgttgccgaaaaagccaagtctcagtaggagtgttaattaacatggaaagcgcaatttttgtttttcatcacgctacagggaagaagcttggatcaaccgtagtgcccatgagtcgaagcgtcatggaatcttataatctacaagacgaagtggagatgacctttgcgatgaaggagttcaaagtaagcttatgtcagtaacatctcagatgtaacgcgtcattgcagcatcgttcgtaatgattttcgtccgcttttgacgtgtgtcatcctctttaggccatcatctcgttcgcattggctcttcggttgcccttggaggcctattttgacgcgagcttccggtacgataagcacatcagtaactcgtggcataacgtgtaaaacctttttttttctcacaccgctcgcatctccacctttgtaggccgtttttgttgcgggttgttaatgagaatgtgatgacagctgtaagtgttgtcagtccccactaagaagtgttgaggtgacgaggttgatggccaagaaagcaaaatgagtgaccttgtgttttcgtccataggcgtttgcaatagcaactattgtcaacagcagcgatatccgggaacggctgatgagtgagcaggcgatgaagctggaagccaaacctatggtacggaaagccacgactcggtatacgaaagactgacgtctcgacgagaacacgaaaagatgactctttaacactcacttcaatggctcataggtttcaaccggccacaataatgcacatgggaatctggacttatcgcaagccgagaacgcactctttctggacgatgacgcggactgggctgatgctcttaatgatattgagatggaagaggcagcggcggcggcagcagcgatctctgctgcgaccgcggggagcagtggaacgaatgggaagagtcgggaggtaactcgggagagctcgacggtggcaactcagagcgcagtcgatgcatacgaaattgaggagccttgcttgcctccgcagcgaaaggtaacgatgtcaaaggagtgtgtagagctggtggccgtctcctctcattgacacgtacatggtctaattttttttcttttgatttttctttcgtttttgatatttccatgtagtcaaagcgagcaaggttcgatttcgatgactttgactaagagactctggcttcattcaaacaatctagaaacaggacgatataaaaaaaaaaacacatttcacagtgtctgtgcgctatttctccgacgcgtcgtgtctcatctgtccagtcaaatcgcctcaatacacacagcactgcgataaggataccgttagagtatatacgcgattctttcatatttgatctgctctcttcaccaacgacgccatgagtaaagtgctcgtctctagcggtacttgggtggtatgcctgaccatgcgatcagggacgcacgcttatcaagccggcacacgccaactccgaaactcttccaggggtaccgtaccgcgtcaaaaagcgatcggcgcaagtcacagacatattgtactactttgactgaaccttggctttgaaggcgtaaggaaagaacagctgcggataagctggctcatgcattgaaccgcactaatacctttttttttatttacaagtgcggttagtacgataacgggggggttttttttttggcatcttcttatgcacgcttctgatgcgaggcgagattttcatcgtcccaagcgacaaactttccactgagatcgtttccagccttgatggcgagactagcaatgacgtgcgcgggctggtctgggtgcagcaaggtcttggtggcatgcagatgaaggaactcggcgtgctgatctgggaccatggcggtggcacccttctcacggatgataccctgcatctcggtatcgacgacacccggctggatggcaacggtgatgatctccttttcttctgtggcgaggatcttgccaaacatgttgagggcggccttggaggtggagtaagcgccccagccgtgataagcgtggatggccgcaccggaactgaccaggatcacacggcccttggcagcacggagggcgggcagggcctgttgaacgacggtgaggatggagaagaagttgatgtcgtagcttttcttccagtcatcaacggaggtggtggcgatggagccgacggggtcgaggacggcggcgttgaggatgaggccgttcagctgacgggaccacgagttggcggcgagggtgagggcctcggtggcggtggatgggacggtgacatcgccgacgacgaatttgaaacggtccttgaggttcagatcgttctcgatgtggagggacagttgctggagggcgtcctgggaacgggcgacaccgatgacgttggcgcccaggtgctggatggcgaggaggacggtgctgcgaccgatgccgcgggaggcaccggtgacgatgagtgtgggggcgatggtcatggctggatggggtggggaggggagggagaagaggttggaggaagagaagaagaaagttgagcctcatatatattcccagagtgagactgatcaagccactgttatgcgggcatcggcattctttgtgcgcagcatgggacagtcgcgattgagggtgaagccaaagctgtgtgggtggaaagggcgtgcttggacaacagcatgcggcatgatgatatctgccggtctgtcctcgcgagcaacctgtgcgctcaaagcagccgatcacgtaactctgagcctgatctcctgtattgttctcaagtccatgacttgcccgacctccgcaacgatgtagattcctccaggctatgctgtcactgcccgtggcatcctcgcggcgatccctagcatgtcatgcatctggggcagacacgctagggtctcgaattctagtctcttacattcgtcctctgagtaaaaaaaggctcgggatcagagccggcgtcatccaggttttgtatgcatcagcaggttctggagacgcgttgagagagttcaggctgaggaggaggacggatcatggacggatcgcatggacgtggagccgcctgttggcggccacatgaaggccagcagatagctaggtcgttagggtggatccgtcactcgtgcaggatgcatgcggtgtagtgtcttgacacgtcgccctgtgcgcacactctcgatttgacacgtcgctgagcgcggaaatgcagcccaatagaaagacaggaccccttttgcggcctgttcactatttcagccatcgcctcatccgacgtggctctctgcatctctttcacgcgcaaccgatctctctccttcgccttcggatccgtctgctgcatccgcatccgcatccacatccgcatcagcatcacactcgcctctcacttctcactctccttgctcgttgcatctcaaccctgcatcctcccttccacctctgctgcccactgctgtcctttccatccccgcaagcactagctccagcagcgtcatagccttgtcatcatgaactttgaagagattgaggaccaggacggcatccgcttctcgttcaatgcctggcctgcatcgcgcctggacgcaaccaggaccgtcgtgcccatctctgctctgtacacgcccttgaaggagcgcgaggacctgccgttgatctactacgagcccgtcacctgcaagcagcacacctgcggggccatcctcaacccatactggtgagtctgcactccatccgctctcgcgctcgctctcgttgcctgtccgtgttgtcacatcggtgcactcatagcgttcgcaagcgactgatgcctcaaaggacacccttttgctcgctagtcaaatcgaccctcgcggcaagctgtggatctgccccttttgtctgcatcgcaaccagttcccgcctcattaccgcgacatctccaacaccaacctccctgcagagctgttggctaagcacacgaccatcgaatacaccttggcccggagtgcacaggtcccacccattttcttgtacgtcgtcgacacctgcatcgatgaggatgatctcaaggccttgaaggattcgcttgtggtctcgctcagcttgctgcctcctcacgcccttgtgggtctgatcacctatggcaccatggtatgtctgtgccagatcctcgcattgttgtcctgctcgtatttcttctgtggttttttctgggttactcagtgtgaactccttttcggtcgaaccgaacgtagacacaagtgcacgagctcggatacagcgagtgcccaaagtcatatgtgttccgtggaaacaaggactacgcctgcaagcagatccaggagatgctcggaatctcagcccaggcgatgcggccacagcagcccgtccgtcctggacagccagcacccgcccccacaggcaactctcgattccttcttcctgtccatcagtgcgagtacacgctctcctcgattctggaacagctgcagcaggatccctggcccgttgccacggacaagcgcccccagcgctgcacgggtgtagccatgagtgttgccgttggacttttggaggctacctaccagaacaacggtggtcgcatcatgctgttcgtcggcggtgctgccacggagggaccaggaatggtcgtcggcgcagatctcaaggagcctctccgttcgcatcacgatatcgagaaggaaaacgtgaagcactacaagaaggcctccaaggtaagaatacatcttcctcatttccactcctattgaagttaatgaactgtggtgtaggagtgagtgcgatatatacttaccgaggctgctgttccttttttctagttttacgagtcgttggccaagcgagcatcgaccaatggtcacgtcatcgatatctttggaggatgcttggaccaggtcggattgctggagatgaagtcaatggtcaactcgacaggcggattcatggtcttgtcagattcgttcacaaccttgatcttcaagcagagtttccaaaagatgttcgagaaggatgctgagggcaacctcaagatgggtttcaatgccacactggcagttcaggtaaaccgcgacggacccttctctttctgtacattacaacttggactgtgtgtggaaatttgatgttctggaaaggtattaacgcgctgttgtcactgcccgtcggtgtcgttgctccgaatatagacgacaaaggagctcaagatttgtggattgattggacatgccgtatcagcaaacaagaagacggcgtcggtgggagagaccgagattggtatcggcaacacatcggcatggaagatgtgcggagtgacacccaagactaccaacggtatctattttgaagtcgtgaatcaacagggccaggtgctccaacctggctctcggggcttgatccagtttgtgacacattaccagcactcgagcggccatttcaagttgcgtgtcaccactgtcgcccgcaggtaagcagcccaatgattcatcgaggttttgcttcacaggataatgtctgttcattctacttgattctgattatatactttttcgtgttcctgaaaaaatcatagctgggccgaaggaaacagtcctattgtcggccagtcgtttgaccaggagactgcagcagtgttgatggctcgtatcgcagttttcaaggctgagattgacgatggccccgatgtgctgcgttggttggacaggatgttgatccgactgtgtcaaaagtttgcagagtaccgcaaggacgaaccccagtccttccgactgtcggagaacttttccatttaccctcaattcatgttccaccttcgacgctctcagttcttgcaggtgttcaacaactctccggatgagacagcctacaaccgccacgtgttgaaccgggaggatgtcaacaactcgttgatcatgatccagccgacgctcatgtcgtatgggtttgagggcgaaccccagccagtgttgctggacagtgtttcggtcaagccggactcgatcctgctgctggacacgttcttttatatcctcatcttccacggagagacgattgccgcatggagaaaggcaggataccaggatcagccagggtatgagaacttcaaggatctgctggaggcgcccgtggcgaattctcaggagctgttgacggatcgattcccgatccctcgatacattgtgtgtgaccagaacggatctcaggcgcgtttcttgttgtccaagctgaacccgtcgacgacgcatgtctctggagggcagtatggcagcgcaccgacgggacaggcgatctttacggatgatgtctcgctccaagtctttatggagcatctgaagaagtacgtgtttttttttgtcatggcttttgtgctttgcgtttgccctgcatgcttttttcgtttgcttcagttgaaaactaacgttttggcctttacgctttttgactccattgtgcgctgttgtactttgcaggcttgctgtctctggtacatcctaaggcaagggttattttttttcaagggcaatcgctggaggagacgagagagaacgagtgtgcgaacgtgggtgggcgagaggttaggatgctaaatcaaatacattatcataatcgatcgatggatgccaatttttctttctccctttcttttttttacgtcagtggtttgctttgcaatctgcggttgggagaagtggtcctaaaaaaccatggagggagaaaggaggccaagaacaagaccatgcaaattgagtacttttggttttttggtaaattattctttttatgaaagaagggctatatatcttgaagcgagacccatcatgccagcaacgagcctctctcctctttttttttctttgtctgtagtgacaggagggtaacaagagtttttggtaggagggtaaccgactattataattaagagggagagggagagaggtatgtacagctttggaaggggatatacaaaaaaaaaaagaaagagaggaagtaagaacgtgggagggtatgatacacaaagatatctctatgggttgtgagtggatgaaaaaacaagcatcggccattccatttccctttcttcactctccaacggttatttgcgaaggagtgagaggtgggacaagggaacagcaggatctcagggtcagactagccccgcttgtttgggtgttgtacatgagtggatactgcatgactgcaagggtccacaaaaaaaaagtgaggcggccatcgggttcacaagctgttttagatagcctggctcagcatgctcaggaccacggcagcctcctcgaccttgcggcgctggcggaacttgcgggcccaaagcctcttgctcttgcgcgtgcgttccttgcggtccttatcgtccttgacgcgaccatcgggcaacgagtcccacttgcacttgcgcgggtgcatcgtcggcgacatgttatggacattcttgagatggcgtctcagattgcagttctggttcttgctgggcttgaaggcacggctgcagacggggcagagcagcaactgggggctcgtggccgtgctgggaccggcggccgagggcatcatggaggacgagaccaaggaggaggacgaggcgttgctgttggcatagaccgattccgacagggacgtcatggagctcgaggctggggagaccagaccaccacgaccttgatggtggtggtggtggtggtggtgatgatggctaggctgaggctgatggtggtggtgatgggcagggtagtgctgctggtgatggatctccgaggccgaggggaagggcgaggactctcgggagaagagcgagcgatcggacgagaccgagggcgagcgagagactctcatcgaggaggagtaatcgtcctcgatggtcaagcgacggctcgaggtcggggggctgtggtagggagtcgagtgcacggatcgggtcgagacctggaggggcgtcatcggcgcatgagcaggcgcgggcgagtgcgggtgtactctggagggggcttggtccatggctgagggcgtcatgggagtggccagatgatggtgcgacgacgaagcggtaggggcccttgagaagtagtcaccagggccgctgccgtaaggtgagcgatctcctcgagagtggtagtgcgaatcacgctgatgatggtactcgagatgatcccgcgacggcaccgaaggtgaagacgggtagagatctctgggtgaagccatgccttgagcgtagtactgcttggcggtagagggatgtggaacggatgcggaatgatgaccatactggtgcgaggtctgctgcggctgctggtaagggtggtgatgactagggtatcgctgctgagcgggagagaagggagaggcgggcatgggcagcttgtggggaatgttcatcatgtgcttgcgctctgcgtgcgagaaggaaggcgaccgactgatcccatcgcagggtgtcgaggggccaggtgagcacgacatcgagcgctccgaggacgagctgtagagactgtggagcgacgaattagagccacgggatgagagagagggtgtgatagagtacgagcgggttggctggtaggccatgacgggcgaaggcgagctgggcgacgggcttgcgggacggtatggacgaggggcggatgaagaagaagaggtgaagggcgcgaatttggtttggatagcgggtagttcaatggagctggacatctcgtattttttttctgagcgtgcaaaaagagaatctagggaactttttttcttgtgtgctcggcgagttcagggtggagagaaggtgatggatcaggaagaggtgtggtgatgatcgatgtgtggaatacacgggaagaggatggacttgggcgataggaataagaggagtgtgtgtgagtgtgtgtgtgtgtgtgtggaaagactcgctgtggttctacgggaatcaatgaagatcaaggaagagagcgttagcaaaccgtgcgttcgaagatccagccttgatttttataccgcttgtgctcggtcactgaggtgccaatgagcgcatgcgaaagatttcgattttcgcggggtagcatttgtatattaccagtggacaaaaaagaaggaaggaaggaggaatgaacggacagagaaaggagcgaggatattagtgagggctaggagtagagatggcgagggtagaagattaggcggaccgggtatgggaagagtagatagacagtcggtcaagagagcgagcgagaaagagagagagagagagaagagagtcgcgagaatgagaatgggatgcaaaaagtggaggacgatgctcgggtttataaaggttccagagttgcaagttacacggagagtttctctttgttttcagttgtaaagaaaggcgttcaaagaatggcacaggatcgagagccgagtgggacgaggtcaagggcagaggagggtagtcgacggcagcacgacgagagggaacgagggagaaggagagcgtgcgcacgagcaattttcaaggagagcgagaccaagatgtttgaatatgctggccagatataattagttttcagtgtactgtaaaaaaaaagagtggaaagaacacgaaaaaaaaaaaaaaaaaaagtaggagtgagcgcgatgcagcaggagagttgtagcgtttgacagcacgagaaagagagtacaggaaaagtagagaatgaaaagatgagaactcaacgacagccaacgaggagggatgaaggaggagagaggatgatgagaagcaagaaagaaaataaaaaaaaagagagggagcaaaaggcaaggagtgcggcacaggaggacttcagagggaatttttagagtactcaagacgaacactaagcagaaattcaattacaacaaaaaaggcgagtaagggagggcattgacaatgcgcattcaattgagtaacgcgctcatgcatcccaatagttcaatactaccattttgttgaatcgagtgaccatgcaccagcctgtacagtacacatgtaacatcatgtttgatcaacaaagaactagcaccgacccgtcgcacgcgtccactgtgcgcattggcgtgcctagtacatggctgtacatacatggccagcaagggcgcatttacttcagaacaacagcaaaaaaaaaggagagtcaacagcagtgatactagatcgataatggcagtaaacgagagtcagacaccgcgccatgcagcatcctccacccccccacaagcctggggctaatgggccactgctaccgtccttcctcgtcgctcgtgggtcacgtcgcctggatagaaccagtggccaccccttgccccgtcccacgaggatcgcagtagactgaacatgcccagagcagcaactcctcaacaacccagtaccgtgcaagtgggcgacagtaaaaacccctcttatgaagagtagatgatcgcggtaagaatttacatcacaaacagtacagtacagcaaattctcattcctccgctcccgcaggcggcaggatgtatttttccatgaaggatgcatcgcggtatatgataggaggtaattcaattctacgacagagcaaccgactctcaaccgaggcactgctatgagaagccaggcagtcgagttcctaggccatgcctataatttttttctgtctgcctttgggcatttaagatcaacggactttttcagggcagtgcaaagccctccgtcctgtactagttttcatggtctgaatatgcgatgtcttcttgcaaagacacccatacctttgggaaaagcgtgcaagagtgcgtgagcttcctttttttttttttgccttgcattcgtagtgtggtcactgcacctggggaacgcgacccaagcccgttgtctttcaagcgcaaaacaaaaaaacctgtaggtggggaggaatgtgcccctcttagagttcgggacagaaaacataattctcagcagcagggatagatccatcccatggacctgatccgaagacacggtgaaagaacaaggatagggagaaacgcgtcaaaagggagtcggggacaggcaaccaggtcaaagacgcgcagtgtgacggacctcagttgacgctgcatgcctctgttgaaccttcgttctccctcccctcactttctcgactctgctgctccctccccttgcctcgcttttgtcctcgccttttgtgcggcctccttccccttcacccagttgaagtgagaacacaagccctctgagggcagaggggttgttcatccatccaagagcagatgagcgcacacctttttgattcctgatcgcgataggtggttgttggttggtggtggttcctgaacatcgctactatcaagtccaaatctcaacatatcccgagctttcgtttatcgcccacgttgttcagagggcgtcgctaacatgactggcataagaagaccataaatggctcgagagagcaacaaaatcagatcgtagcttgaaagaaggggggttgagcgatgagtaactggaaagattacctactctcaagctatcgaggtagattgaatagtgtggacatttgcaacttgcattgtgccgcatacatggactacagcctaatcaagattcaggggcaaaacaacaacaaaaaaaagaagcaaggaggacaaaacagaaggaacacaattgtgcacgacgtgcgacgaaaggggtgaggtagggcagagcgcccacaaaaaaagcaacaaaagaaggggaaggagcatcgaccgtcgcaattatgtgggcaagcaaaagcaattgagcattgaccagcccttgggcttctgtgcctttgagtcgtgcacttggtgctcgtctctcaagagaacacaaacaatacccacagaggggttttgtgcaccagccaagcgaagggtcccattatgccaatctgtaacacttgaacgcgaaaaaattgttagaatacagtacatgtaggcgcaatcctggtgcaaatgcatagatgctttctagcacggtaacaattagtatcatgcaaacacatccatgagagatgcaccgccattcctcatgtctgtggttctcccagtccgttggtcgcggaccatcgtatgcctttattccctccccacccccccccccccctcctgctcccagataagatcccgcctgcccttttttttgttttggaagggggcttgcatgcgtccatttttgcatacatggtacgcgcagctggctacggcaccttgtcttccccgaacaacaaatgacccagtccaaatcgcgtccacatgctgtggaatggatttgcgttttcctctccatcggagagcgactagtgtcaatatttctctctctttttcaactgcaaaaatagaataccttgagaggttttgctgtagtgcccgacctgaggtgccaaacagtgcgaacggaccatcctggccgatcccactcctgtaaaagtctgaaatgaagacacaataaagccttcagcccttcgagtgctccttcccctggcgaacatggtcccgccgttcccccctcacatcaagccttaccttttctctctctctctctttctgtcgttccctctatgccgaggaaacatacaggctaacgatgctcatcgtaatatattcgacagagagacgtatatatcattgcgtgcgttcgccactatcggtaccttccgcgatggctcaaccccttgagccgtcttcttcctctctacgaagatcgaggaatcgaagcccgcctattctgtgcaacacggatcgaaattctggctacctaatgtgtttcatggtctcgaatacctgagctccccttctcttcggtcgtacagtagccgcagtggcgccgtgcctctcggtttcgcctcctcagagcatgtgtgcggtagattcgtcatcgacgctcacagatgggcatccgtgttcaatcggtcgctgggttccaaaatccttgttgtacaaagtaaattacgcagggcatcgactgacgttcgcctctgcgtttgcgactcagtcttcctagtggagcgcgcacagcgtccttggacacagggcgacggcgtgtttttttttttttttttttttactttggcaggagatacaaaagcagggctacttgttacaaaactgaagtgggcgtcgcgccagcctagagctctctaagcgcgcgctctggaacaaattgatcagacgctccagcctcacacatctcatcttgcatgctttacttatgcaggccaccggctggtccatgctcagattgcatctttgtgtctactcccgagctatcctactggtacgtttgtttttagggagcgaaaagatgcttgtcaacatgcatgcaatagacagtgaaaagaggtccaactgaagggacaatcagcggtattgtgtgcatccttaattgcattaacgcaaaaaagagagtacacaaaacaatcaaacaaaccatggtgcattctctcccccctccttccctctttcctccacggtagttcagaaggagctcctaagcgcagcaaaagaacggaagaaagatctctactcccggttgccgagtctatcccgcgccccatccagtcttctcgaactcgaaaaaatataaagtaaaggcgcaatcagtactgttcaaatgctgatgtcgttcgctgcccaggttcaagttcgttctacttggcgctagcggcaacgagtggactctcctttcctttttgctcccacatttttttttcttccttcagctccccttctgtttatttcttctgtccacctccttggagtacctcttgaatgttttgggtttacagttcttctacaacttggccgtggttgttagaacccccttttgtctgcatggctcgaaatgctctgcgatgcgatgcgagggcccgcgcgagtgtgtttcctctggctgctgttgcttttgctttgattgcctcgactcgggctctcaagactttttcactctccttccacgcaagctctcgcggcaccaggtcctcgagattttttgcaacgcccattccatgcaggagaaaggcccaaaacggcaatacattttcaaacatacaagaacaaaaaaaccgttgagttccctccctcccccccgccttttcccacttcagtgggcgccttatcatgtagtagcccataggtgatgcaactctgggagccaaggagctgcatgaataagagcaatcctaggatgacagtgtgtctccttcctgaggcacagacctcatctggcattagatctctaacggcctggaccccagcctggacacacaagtccgatcagcgaccgttgggaagttattaggtatattgagcatgctatcacccttaggcccagatgtttcgggttgggaagggcgtcaaggaatggcgtgcgaaggtttgtggagcgggtacctttagaggcgcgctattcgacgatgtcgccctttcgcgcaagagctagatagacgagtgttcactgtagtctagaatccatctgactttagggctttgcgtctacttatttctatccttttcgtaagctttgcaccagggcagtcaagtggttaagcaatattggagcgtagaatgctggtcgcaatttacagccgtagtgctggcggggacgtgctcgcaacttttgcgtagggccacgcgcggaccgtctcggtgactgtcaaatcaagccacaggataaacagatttttgtcccctgatggtaagcgtataccggatcagcacagctcgggctttccattcaactctctcaccacccaggcagcagaagcagatcatgttcaagtcgacgatcacacagtccacaccagcactggctcgcggatatgccaccaaaatcggcaccagggtgacccgcacgatgttccctcgccattaccgtctgcgtcacaagattcagaacgagtccgatgcggtgcctctgcaggatggttcgttgttcattcgtcgccccactgctggacctaccacctcgatcctctcctcagcacatccttcgcctgtctcggtctcttcacgggcaccagcgactgccacaaacacacccattacacaccccgacctgcctccagcactgcatgccaaaagaaccgccgctcgtccacagtttgcaacattgacgcccgaacagattgcagagatgcaggctcttcgccttgagaaccctgccaagtacactcggtcatacctggccaagacatacaacgtcagcgagctgtttgtaaagtgctatgtccccgcttcaaaagaggttcaggttggaaggatcaaggcccagcagcgtacattcgataacaagggttggaaggctcaggagattgtcatccagcgacagaaacgccgcgagctctggtagagagatggttcaggaaagagaaggtccagggctgcattccaggaggacgtctcaaagcatgggatatcaggataggggcacccacacattcatatatcactgggaagctcagaataaagcatatgtaacaatttctgtgtgcacagtgggatttgaagaatagagaccaaagtcggggatgatgttatgaggcgagcgccaaggtatttacatgggaaggaccgtgccataggcgggtagttgattatggacctggggatcgatcgatggtgtcgctgtggttcaatagataatgaccaaggtattcaaggggattttgtggtctagtggagggtgggacaagaagggaggtccgttcagagggatgctgttttggatcgagtgtgggtgttctgttcttgggagcttattgacaaaatggagttttgcgtacctctcctttgcaagttgcttcattccttccagcagcaccggcaggaccgtctgatccagataagggcggatgggcatggctgcaatctctgcctttgaaagacccaacaaaggattagtcatcgttccagttgctgaggaggcggtggagccctcgcggtcagcgttgaggatctcctgcgatggttcagttatcaggaaaaaagtgtcccttgttagagtgggctgaaatgtggaagaggaatcacgaaagcttaaaggaagcccatgtcggatgaccgttgcatctcgccgcataccccgaaattcttgacaggaccgcgatgagattcgaccttgacgctccgctcccgttcttgaggtgctggcgagtgtctgctatccgagtccatggtgatgcctgggggttgtggagaatcggaggcatgaaaagcgaaagggaaggcgcttttgtggaaaaaaaaaagtagaaaaagacgaggatataaatgcggcttaaatccttcgtcacttgcagggcagagcagcagcgagaaactcgttcaacgcgttttgactttctttgttttctgttttgcctcttgactctaaccatttgcccattcacactcgcagcccatcctgcatttctgcaacgcgacaatggccaaagcaaagtcagcaggcggcaatggtgggaccaagtccaccggctcatcctcaaagcccagaaaacccacgcccatcgagaccctccgcaccgttgtgccgggcatctttcaggaatcccaaaagactgcagccaaccaccgtaaaaacgccattatgctacgcaagcttcaggaacagtgcgcagagacagctggcgagcagggcgaggtggccttcaacaaggagttcattcgaaatctcaacgtcgtactcgccatcaaaaagagagagcctacggctgatagagtcattcagtttgtttcctcattcattctttgcacgcgagaaaagggtaggcggccacttcctctcgtcgctagagcgcatgactttcgggcaccctttgtttcaataactaacagcctctgcaacccaacatagatatggtgaacgaggcaacaaacgaggaggaagaggaggagggtgccgagggtatctcctctcgatttgtagaatatcttatgcaccatctgctgaaaggagtcagagtcaaagagaagctggtccgcctgcgatcctgccagcttattgctttgagtaccaactcattaggcgccatcgagtaagaatatcgcttcgaagttgtcagctgtacatcaaaggacgagccacttacacgatgatcttcatttcatagcgacgatctttatatacaactcaaggacagcctgatggagagggttcgggacaaggaatcagccgtgcgggtccaagctgtgtttgcgctttcgaagcttcaaggaggcgctgaagaagaagaggcgggtggcaatgaagataatgttgtcaagaaactcctggatatgatggagcatgaccctagcgcgtaggtttcagtgattctgttttggacttttcccggcaaataatgaccttcctctccatgtgctcccaggtgtcgtaacgaacttctgctttacatacgtagtgaggtccgtcgttcagcgctcttcaacatcgagcaaagcaaggtcacaatgccgtcgatcctagagcgagccagagacacggatgcatacaacaggcgaggagttttcacaaagcccatggaggagctatcagatttccgtgtattgtcaatcgaagacagggaaaagttgctgcgctatggtctttcagacaggtatttgccgcttatggcagcctcgaccgtgtgatgatcacgaacgcccttgcacgtactcacttggcctttactttgtcttctagagatgaaggcgtgaaaaaagcctgcacgaaaatgcttgccacaaagtggatccagcaggcggacgacaatcttttggagtttcttgaaaggctggatgtaatgagcagtaatgtagcggacgatgtgctcaaggccttcttcgactaccgtgcagatattctgggcaacctgacatttaatggtaaggcgcaatgagctcagtcccccatgcgatattccaaaatgttatcaaattgtttgactaacactcggagaactattcaatagatgtgttctgggtcaatctgacggtggagggcgccttcttggtgcgagcatttgcagagttctgtcgtggcaaggacgacgacattcagttcgaaaaggcagtacccgaggtgacgaggcatgcattctacattcagaagtacagcaacattatgcaggaggccgacgaggacgatcgaccggaagcagaatttattgttacgcagctgctgatgatcgcaaagttgcttgactacgcggacgaaaacggccgtcgaaagatgtttaatttattgcgtacgttacatgcacatgccaaaaacagatggacgataaccttcttttgtggttgttacgggcactaatcggttaatatctttacaggtgagatgttgatgctggatgacattccagacaagcatctagactgcatcgtcgaaaccatgggcaaaatctcgctgaacgaaaaggactttacgcgtatcatcattgaaatcatctcggatattcgagccggcattgacgaacaggagtttttgaggaatcccgaaggatccgaagtaagcagatcacctattcacccacagggctttaatgcaatgtgcagcgtgactaatgtcatgcgagcgcactccccacaattaggatgaagaggagtcgccagacgaccagaccatggatttgaccgacacgccacggaaacgcaaacgcagcatgtcaaggcggagatctgcagcgacagtagatgcacaagggcagggacccaacgaaattgaggctatgttgattcgcgtacggtgcttgacaatcactaaatttatgctggagcggagtactgagcctttgaaagagaactcgtacatgtatggacttctcaacgagctggtcatcccggctctggcaaggaacgaagaaattatgcaggagctcggtctacactgtttaggactcatttgtgtcctcgatcagaatttggcgcagagcaacatggagctgttcttgacgtgtatctttgccgaaaacgcaagcactcaacttcaagtgctctcgctcaaggtacagatcgttggcatgcctatgagagatgataagtgcatcttgcccatcattggcggaaatcgttaaccacatcactatcgtcactagatcgtgttcgacctgattctgaccttcggcatgaaggagatgtcctgccatgtgcacgaagagaaaatcattcaggatcttacaaagtgtctggagagccctataccacaacttcagtcggttgctgcagaaggaattgccaagttgatgcttactaagctgctgaagagctcacaggtaaagggcgacatatcatcccgcatccgtggaaggtacgcgtacgaaagaatatgctgcatactaatgtaactccaccccctccatgactcctcgcagattctgcgatcattgatcatcttgtacttcgacccagcgaccgctgaaaacaaccatctccggcagtgcctgagctatttccttcaggtttattttcactctgcgcatgagaatcaagtcgcactcagcgaactgttcgtacccatcatggtccagcttttggagatgcaacaggaggccaaagatgagatgccaacaccagtcattatgggtcagcagttactcgagtggtgcgaaccccggcgggtcctcgggtaagccatatacgcataatctctaaagtcatacatgagccagaggacggacaaggaaactgatagttttccttttctttgtcaataatctagagccgacccagagaaggaaggccccgcagacggtagcatcgattttggactaccagcaaacattgccattgaaattgtgaaagctctgttcacggaatctccatgtatgttactggcatggtgttttttttttttttttttttttttttggttagttgaatatagtttggctctggcgctccaaaaccaagagttaacgtctctctttgagctttcaatagatattcggaaacacttgccgcatatcctccacaagattcgactggacggtgatgctggtgaaattcgactaaagaagatgtcgctgcttctaggaaacctcaaaggggtaagcgccttcagtttcgttctccctcaacggtgtggcggtcatttgcaagcactaatgttgaggtgacccatctaacaacgactatgatgcatgacattatctagaagcgacctattgaagagcgcatgagcaaaaagtatctgctcttggtcgaaaagaacatcttgaagatgtttgaggatgcgcccgagtctttggacgatgcagaaatgatgaagctggcagagctaacagaagagatttcgttcgtcaacgactttgaagcgcccgaagaggacgaggagcccgtggtgaccacggccaccaagtctagggccaagcccaaggccgctcccaaagctcgcaggtaaccctcttttacgattcgatcatccgctggtgcgctttactggttgttcacgcatttttctaacatttgggtgaacttagggcaaggggggcatcaggagacgtaaatgccaaactggccaagatctttcaagaggtcgacgccatgcttgagtcttcagaatcagagcaggactatgagagtaaggatccgcaagcccaggacgagtcctcagactctgataacgctgacgacgatgagtattgaaaccgaggtcaaaaagagattgccataaaagtggacgtgaatagtcatagttttatgggaagcgagcaggtgttctcgcgcgatatttaatagcggccgcgtttacgttcctcgtctcgaggagctgaactggctcccctctttctgcttatctcatcttcgcgatcccaacgttcctaaccgagtgcaagtatgaaagaattgttaggcgagtgggaaatgatgaaaaatgataactggagcgaaaatcgagccagagctaatgccacctatcagtcagcattctcggggaaggaggggaaggagggaaaggagggaaggagggaaagaggacgagccgggctgtttctggcgagctatcgtagtaccttatccttctcggcctgggtcttactgctgctggcaccgccgcctcgacgatcgtctctgctatcggatgaccggtcaaaccgctcagtacggtcgcgttctgaccggtggcggtctctggagtcgcgcgagtcgcggtcgggcctgtctctctctctctccctatcgcgttcgcgatcacggtcgctcctggagcctcgttcgcgttctcgactacttccacgcccactgccatctcggctcgagacacggctactattgcggtcgcggtcacggtcgccacgcccatctcgactttgatccctttcccgatgatctttgctagcgccgcggtcgagactgcttggccgagggcttcggctccgtcggtcatcacggtcgtccctatcgtttactttaccctgctgtgaacctcccatcgaggatccttgtccctggccctggaactgaccaccttgctgaaagttgttgatgccttgatttagtggtgggcgtccgccttggaagcccggtccgcctggtccgccagcattgttgttgttgttaggtccgtcccattggttaaagccttgtcctcctggtcctcctcgattgggctgctgggatctgaacccatcgggtccttgaccttgaccttgacctggtcccatacccatacccatacccatgcccatgcccatgcccatacccatgcccattccaggcccgcctcgtccacgaccggcaccaggaccaccgcccatcatgcctccacgcatagcagcagggccaccggcaccacgaccgttgccgcggaagttgccttgattgaagccgccaggtccatcagctccaaagaatggcgcgcctccttgctgaaactggttctggaaagagccgttgttgggaccgtcgccagtctcatccccgccgcctggtgcaccgatgctgcctttccttgcgaatgacggactcttgccaccatcgttgtcgccaccaggtccacctgagctcgatcctccgtcattgcctcggccacggccagctcctggtccaccctgagggccgccaggaccaccaggacccatgaatcgtccacctcgtccaacccctccggggcctccacgctggttcattggattcatcatattgcccataggcggcataccgttcatgcccatgcctggcatggggggcatgcctcgaccgcccatcatattgggcattcctggcatccccggcattcctggcatcctcatccctggcattcctggcattcccataggcatcattccagggggcatgcccggcataggaggcatacccattccgagatcaggcaggtccatgagcatactggggtcaatatcgaaccccttcccgcctgcaaaggggttgtcgcgcatcatcttttgcttctgacaatacgccctccagatgttctcgttgaagccatagttgaagtaatctgtcagatccgctccaggttttctccagggtttgtcttcgacaccgtctagatcaacatcaaacagctcgactccgtctatggatcccaccgcattgatgtccagtcctcctggtttggttgcaggaatgacgtccacagttccgttggcgttggtcacagtcgtcgatcctggtttcgtgggtgccgtagctttgatatttacaacggtttgcctaacgtttttttttggagagtgaccatgttgcagttagatcaaggtcgaaacgttccacaacgaaagtacagtccagaaggtaaagcaagaggtgctcatgagggtaggaagtacaggcagggcgggaggattgcgatcttccaatacatactttgaagcggccgacgattcctgccgagtctcttcgtcatccaacacaatctcgatgtcctacaagaaccagaaggcaaaaaaaagcaagatgtgttggttttcacactctttaggagcaccactttcacgatgccaggaaaattgaccaagcactttagaaactatgtcctgtccgttattttttccttaccgactcactatcgtctgcctctgattcgtcgtccgatccttcgtcgtcctcctcgccgtcttgatcagatttgctgccgtctccgtcgtcctttctgtctccggatggctgcgtggcgcccgtcgtttctgcagtgactctgacttccgtggatctaaaatacagaatgacccgtgatggtgggtttgtggtcagacatgaccgccagggcgcgagggacaatagtcactccagaagcaatcatgaaaaatcctctggtacgttacttggatccgccttcgcctcctacgccgtacaggtcgaacgcttcgctatcttgacctagagagacaggcgtccagtgagccattgaaaaagagaaaatgcgttgatgagacaagagacctcaaggagccgatccggttgccccaactcaagggctatcgcgcctcgcccaacagctttgacgaggtaggtgggccaactgacgtttgatttccaggacaaagaatgagggatcattgggatttaccagaggctgactgcgctggagcatcggtcgtgggttctgaggagccgtacagaaactcgtcatcgtcaatgtcgtctggtatatgggcactcatgtttcttgttgagacgaggggcgttcactctccgttttttgcacttgtaatttaggggtgatttcctcgattgcacacctccaaaaatcaaaaaaaaggcgagtggaaacgggcaccgataaagccgagtgagcgagagagagaggggttcctgttctggaatgtgtcctggagtggttttccctggatctgacgatggggtggatgcagagcaagaacagcagcaagaggaaggagcgagggatgagagggtgcggacgactgaactctgcgcgcgcgttgtgggtggttcgaaagctcagagtggccagtcgcgggccaagccacccactgctttgctcttttcccgtcacaatcagccaggcaggcacagcactttagaggctgtacggcactcgccccacaaaggcgagtagatcgtgggtaagtgcggagcgatagcgagatgcttgctgtacattacatccatgtatggatctgttctattgtgtttatcttaatatacatttacgttggcaatgcctggctgactttacggttgtatgctatggccaacaggctcagaggggtcacccttaaagttgtccagtcgccgcctgagtaggttttgttgcctctgctgagcagccatctccaagctctcgacctcggctccaccgttgactcccctttgttcgctgtaatcgagcacatgaagtgtcttgcctgcacgcgtggttccaaacgcctcccacttcttaggtcgtttcttgtgcttgtgtaagctatcggcctgaagagtacagattgcatgctgcaccaccgtggaggcctgcatctgacagagcgtctcctgctcgcaggccgatcccttgtggcattcccgagcctcagacgaggatttggattcgtactgcagatacttcttgaacagatcgcgatcctgcttcatccgttccactgcgcgataccagaaatcgggtgagaggggcgcctgggagtccaagggtgcctcgggatcctggtatgtttctcgggcagaatactcgatcttccactcgggctccatcccgtgcgcttcccagtaagtcgcctggtcaatgatgtctgcagtggctgtgtaggagtttaccaccgaaaatgtcttcttgtcgacatcgtaccaccgaatggcctattattattattattattttcgcaaacgccatcgagaatcagtactggtgattgtacacaattatggaacaactaccactcttcttgcgtgccttccatctgcaacttactggattggatttgtcaagaggcgtgatgctgggtccctggtacaccatgttgatggccgattcttcactttgctcctgatctgggtcgtgcacgatgatgaatttgtcttggtggtagtggccactgaacacgcccgcaatgacatgaggcgaatatcgggcgacgatcctctgaaataatacagaggctctaggcagagttcgcgtcactggagccatatgtcccatgatccaaactaggagatgtgggcaaggtgttagacaatgctcctttgtgtcatcctccctccccaatatgatctgtcatgatgcatcttgttctacctctttcgttgtgatcctcactgtcctggagctcaagaatcaagtcgtgaaacatgccgctcggatcatcctggtctgtgtccagcatagtgaaaaagttgcggacgtaatacaggtccgtgttcaaggtgatgagtttcagtcctggcataggcctggtcatgaacatggcattatgagagcgtgcataatccgcttcagaggacgagatccagttgttcttttcccagatgccagcgacgtggtcatataacctatatataatttcagggcggaacacatttcttttttctgttagaatcccaaatctgcgaagaagcgtgacaacccaaacacaagacacattcctgctgactttcaccatttatgagtgatataggagttgggtctcatcctgcctggcgcctgatcgcttggataggagtcgtggtttcccatggcaacgtacagcttcatttcctgtagatactgtttgaacagctcataactcctcgtctcctcctcctcgatgtatttctccgtgatcatccaggagtcgtggctcgcaatgtctcccgtgaacagtccaaagctcgcattagggacaaatctctggatcgcctgcaaagcactgagtcccagcgcaatgggtgtatcacatttgccctcgccccatttggaggcccgcttcttgatcgggccaggatcgttccaacggccatagtcgcgacaacagatattatggctgcacttggcctcggctcccggtcggtagagtggatccagatgccagtcagaaaagtgcaggacttggatcgtctcaccactgggcggaggtggttgagcatggacgggtttcggctttgggaaagtgatgttttgaggaaggtggagcggtacaggacacgagccagggaacgaataggcacaagcgtaatagccgtcggatcctgtcaggttcatctcggcagagatgcccaccagctgaggtcccaacctttccatgagtcctacgcatgatcgagacaaaatagattctcgttagtctcccttttttttttctctctcgaacatgccattaagactggcacgcagaatcgacggtacactctaccggcacaggcatcaagccgcttgaacgcatatctttcacacagggaacgaagtactccggggagtaactttggtgcctgcagtgcaaaggtctgtgcgatctgcatgccctgttgacacatctgacaagagtccagggtctgagagtcaaggagattctcaacgtcgtcatagaccttgtttgccagataaagctgggctctgtagtcaactgtgcccgacccatccagtgattgtctcttgtcgttggcttggatggcgggagagaaaggggctgcctgaacggtgaatgtcactgttaggatcagacatgagagactgactgttcccaggaacactgtgatggccgcaagcgctttgaggcgtgcccttgtggtcccatgcatggtaactgtggttcggaagggaatcgtccgtcgtcaacaagcgcagtgaagattcagttgcaggggtgtgcaaaaacggagtgagagcgagtgtgagcgtgcgaatgagtgaggtcaagtgtgagatcgagagtgagaagtgaaagtgagaatggatgtgtaagagagcgcagatcctacatgcacagacaaaagaatacctgtggcgaaggcacagaactcgcccacactgaaaatagatcccgcacagcccactcagggaccaatcaagccaagatttgctagaaaatcatcgacgtttattacgccaacggaagctcgtccacgcggtactagttaacgccgaagaagtagaggtccactctatgcagaaaacgaaagaagatcgctcttacaaggccatggcagcggccacgagaccaaggacgacggtcaagacaccggcagcagtcttggagccagcattgccaaccttcatggtcgagcatgtcaaggcgcggttaggggtgggggtgttagaatcagtggaagcacagtccttgctggtcaagaccttcttagcctcgcccttggccacgttgcggatccagttgaaaggagcatccccgggaaggacctcagggtggacagcgcggacaatgtcctgaagaacagcatcgtccatgacaaccgcgcccgagaaccagtcgcgaccatcattagggttgacaattccatcctcgcggaaaatggccttgttctgaatgaacttcaagggcgaagtagcgctgagctggtagttcttgtaaaaggaatcaatgtcctccccagcaaaggtctcgtcaataaggatatcaacgtccttgacggcatctgcaaaggcggcagcagtcgagaaggtgctcaatgtggttccgttgtaaaagttggcaccggcgtcctgagagagaatcttcttgtaggcagcacccgaaatggtccacgaggcggtgttgttgttgtaactcgcgggggcaatgtacgaggtccaggcaataacgggcttggtggtgggagtgttagccgccttcttgaagcagttgtagttgttgttgatcgtcgaggtcagcttttgtgcaggctcctccaaattgaagaaggtcgagtagaattcgagccactctgcacgctgcgagtaaacgaaaaagtacataaaaaagaataacgttaacgaatgggcaaagcacactcgatgaaatcttttgacgcccaacggtcgtgtcaccggtggaaatgcacagtgctcacagcacaagagaaaagcaagatggtgcataaccatagactctcgctttgctaatgcccctcatctgtttgtgctctcggaaaagagcatcgattcacctggtcctctttgcttgtgcgtgcgccggtaaggtgtcgaaagcagtagggctcacattttttcactcgctgatctcgcaagtccaggccaagctttaaaaagtctgaaggggacgaatccaaacacactgtgattcggaagaggaccacccgactctgaactgaagaagcgggcctgaagcactgcccgataccccacttttctctcacgcctgcatgtatagtgaaacacttacgttcaatgggccgggatccgatacctccgaggtgaggacagtcttgccctcaacggcatctccaccgagggtggtgaagacgacatcagtcttgttaagctgctcagcgcgcagagtaacgttcttgtcctcgaggccaataatctcgctcttctccagtccagcctggatgcagggcgagttaaccagcgcttcagtgtcaactaccttgatggcggagcgcttgcccagcatctccaggtacgcaacagccgtggtggcgagcgtggccgcgttagtcacgggcacgttcacgaagacggtaccattggggaactgggcggggctggggggaggggctccgcactgggtgagcacatactgcttgttcacacccacggcagtgttcgtcacgatcttgtagtgcttctcgtaacggacgctgaaaagcgcagcattgtcaactacaaacgagagagaggtggagcggtcaaaggtgatgtttgctcgtcgttgctctggttttcatcagacctcggagcttgctgttgcgagaaagacacgacaaccaaacagaaccagccaagatatcggatcttgaatctctggcacaggcaatgaactctaaacccgccagtctcgcccccgattctcgtgccaacaaaaaaaaccccgtttctgtcgttcgtccgtggcgggtgtatacgctcaagacagtcatcccacagtctccactgcatgcgcgtgtgtcaacagcccttaccagtgatcttgctggggaagtagtcgacgttggggtcgtaggtgacgcagccgtctccagcgacaggagcctgaccttgagcctgggcgggcatgaccaggaaggggatcaagagcaggaagacgcagatggagtgggcgtagtacttgctgaagacgctctggccgtagaaggacacgggctgggtccagcgggggacctttccacccgagttggtgggagggatggggatgctctgggcggccatggctgacgggatttggaggagaagaggaggcggagggtgctgggggaggagaggggctggacgagggactggaggagggactggagcaggaaggggcaggttcgcggaaggaggatcgatcgaaggggaaaggaaaagaaaagaagcgagagcgaggacgaggctgtatttgtatcggaagccaaaaacgaagacagaaatcagacgctgtccctcgcccaaccctggatcagcgtgtcaaagagacagcgacagcgagaccgagtcgctgagagtcagagcaaccttctcggaccaaccacagaaacgtggctctcattaaaaaaaacacacacacacacacacgccatcgcatctcgtgttccctacccctcatctcgtctccggacacaagcatacacaaccgaccccgcaaatgaacggctcgatcctttgtggttttgctgaaaaagctgacgactgtgggttaaggacggcaaaaatattaaggatgtatcttcatgcatgggtgcatatgtgtgtgcatcactgcatagcgtgcatgaaatacaaaaatcgaccacaaagtctagcctcgcttcctcctttgctagaacacgatcagtaaaaaaaaaaaaaagtgcacctgtgaacgacagtggtgcagcgaagagcgatatgcgagaagacagcagcaatggaactccgtcgttcatttttcccacactgtgccgcaagatcagtgaaaatatcccggaagggtgtactgaatcatccccatggcgccctttgctttaaagtatgttacaccaccctcagccgatcaaacgcgtggaggaaaggtcctaacattgcgcgggctgcttccatcctcccttcagtcacctctgatccacttcatcttcgaagctagctaggaagaggttgagtatggtgagaagtcttgatcgcagccttggtcaccagaacctgcttggcttgcatttctgtggctgtgccctatcgtcaagcgctggcttggatcaggtcacctggaggagatgacaacgcagctaaggtcttccgggagagactgaacgtctttggtgatcgttaaggctcaaacagtcgcgtggagcagacacaacaccggccagctgcaacggatccagaagggggccgtcacttgaagaaagacaggtacaagcacgagatataggacctgtatttgcactagcggttcatggatctactggcacatgctcaacaaagcaccatatggtgccagccactcaggctcatgtcagtcggtatgaaactgacagtcaggtagatcactggactacacccgcgcttgaaaatcacggaggacaagaggacacgtgagggaacgatgggggctcaggtcatggcggagaggtggggccaagggatatggaatgctcacggcttcagagcggctcaccatcctgtaccctccatctccttcctgtcaaagaaagcgagctcatgcatcaagaaccccaggtcgtcctggcatgctattaatacagcaccatagtccactgggtgagttggcgcaaaagttggacccctcgctataaaatcttgccggatgcccatcgtcccctccgcttcattttttacaattttcattgccatgccctcctcccccatcatcacagccaggttccatcatgatgttgcggactcagtttcacacattatcttcactttccaaaagtgagggtggctcggtgtttattacttcagacggatgtgttccccttgctgacaaacaccaccagctggtatgccaggggtgtgccccttcgtcatcgtcttaaattcccctcgtctcacattatagcctggttcgttcctggtctagagcagcaggtcggggtggccgttgcgggaaaattgtatctggctacaataccgcattatcctttacgagggggcacattattacatgctatacacccactagaattcttggcttgatattttgacgaagctaaaaccacaagtaggtacgtatgaaggtttagaccaggcacagttgtacaaagtcagacggaatctcgaaaatactattctcaggaactcaacatcatatcacaaaggatgggctaccgacaagatgatatgtcgcccgctcggctggcatgggtaacgaacagaaaagcagaaaagctacgagtgtgctttgaacggctcgacagatgaagtctccttccactggatcatcgatcctgagctcaactgtacattcaatggccttgttccagtgtgcttcactcgctcgatgacgcctgtcgtccgcgcacttgcgggctgcctgcgcatggtttgttagggactcttgagtcaagtacgctttgggcgatttttttgtgtgtgtgtgccttttcgttgtctcctatttcatttcattcggcctcctttcttgaccttgtccgctcaccgtctgtctcccagatagcgtcgttccttggctggaagggtaaggatgaagagcggccaacagacggagtgcttccttcgcgtcgacaacacgcaagggaggttttgaggagacgaccgagcacgccgctagcgcaccgtagcctctccacagctctgtgcctcccgatggcctgtctgtctgtctgtctgcaccttggagcggacatttgaccatggccgtatcaaagtttctaacgcatcccctctcgtcccactgcccctcccataccattccacacatttaccatccactgtcgaccctaccatagtgcatcgggaagaaatttgcaaccgtgagcaccgtgagcagacctccagacctggccagggaagaaaaaaaaaagggaacagggaaaaagaaaacaactgcatagccagccagggcattgtgggattgcatggatctgatcaaccccacacggcgacatccatccacctcgacactgccatccagccggcaccagcaagccgaggcgcgtttgagcacaagacgaaaccccctggcaacacgtccgacacggccaactgttttctgttcttgaccagccattgacaccgtgagcaggtaaacagcaccgactcgcgcaatcccgtcgcaatcgactccttggcccacccccactgcttgcctcttgcctcccccccccaccgcacccctcctcctccgccctctttatggcccctcgctctctctattttaacaaggacctctgttaaagagctcgctcgccgtctgaacccggcttcctgtatcctcttgcaaatcccttattctctgtattcgccccttcctcctcagaaagcgctaggagatctatattcccagatgttggtcccccagcccacctcttttaccctctccgatccagactcgcttcacctcgccctcataccatccgcacccagcgattttgcaccttcatttgcaccagcgcacccccagaccaggattcatgtagcggcaagcgccttcacactctcccgaccaacgcgacaacaccgccaacgacgaccaagaagtctcctcaagtcaaattcaagcgccatctacggagcgtgggatatccagatcaagagcgagcaccgttccttcagcaaagcaaaggccagggcaggtgcaggaggatcgagaagggacgctgccgacaacaaacagactactgagggcactgaggacaggatgtgtgaggccgacggctcgttgcagagtcaaatcatccctctccatgccgcaacctctcgtgcgtccagactgaagggaaacatacccgaaactcctgaggcaggttttcctgcctctcaagacctccttcagccgtctcaagccgccgttgctgtcagcaatgcaacgacagagtggacagtgggccaacagcaccgcgacaggatcaatgcgaggtctcatgctgctgtcgaccccttgctgctgccgcaaacatatgcatccaagtctatgcccggaagggctgcctccaacagcgctgccaacgcccgatcagacgatggatcgagtagcgctgttgctgatcccctgtctgcaagatcaaagtttctcaaagccattggcaagttcaagagcaagcatctgctgcagaagaggtatgttggcatttagactttggatggggcacttgtattttcagctagagcatattctcccctgccctcccccttcctcttctattctctgttcccatgcaccatctgacccagttcatgccgtcgcctatgcttgttgtttttgctgttgttgttctctcccccccttccgtgcctgtgggttggtcatccatcgggatgcgctttgtttccacgttctccaaggttcagtgtgaaacttttcgcacttttttttgttttttgtttcccgttcgtgttaccataaccctttttttaacactttttaattgcaattctcctctgcttctgccacgcaccgcttaggccaaactccaatactcctgctgccggacctgaaacggcgtctgcgactagccacgctagcggccgaaccgcgtcgccctcgaacgcatcatcgtcccacgtaccgccacccatgcaccatgaccatggctccgactctaactctgtctcaataaattcctatgccggtcagccgctgtcggaacggcgtaaagagcatccgtccgacactgacatgacggattctgccccacaaagcccaatccgtcttgctgaggatcgtccggcgtcgtcctctcttcgtgtcaaactcaagaatcgagtgcacaacacactcgcatccatgaagtcttcatccaacctacgagaccgggcgcgattgcaagcagcggctgcagttacgccaggatcgtccgaaaataaccacgagcaccagcagcaccagcagcaacatcaacagcactcatcatcgtctgatcataccatggatccacaagcacctagcccgagatcccgtcatgctttctggtccttccctcgctcacgtcctgactccacgggaactacagcttcgagacagttaccatggagcaccagcactggcccaagctccgtgactgaacagtcagtagcacaaagcccagcacctcccaaagagcaggacatacccatgctttcgcccgagctcgctcctcgtttagagtcttttggccatattgatgtggacgacgtgaactcggacgattcaatggacattatcatgccgagcgattacgacgattatacccagtttgccgagcttcctttgaagaagcgcaaaaagatgctggcagcagcagcagcggcagcaaatcaggacccctctcccaagcgaccacaggcgagcaggatgaactcggacggtatgaaacggttcttgcttcaacaaaaatcggccggcgacaatgctaaggggaagaaaaagcagttgcaaacaaccgatggtaattgcgccgcttcctctgcccagcaaacgtcgcagaaaaacagtaagaaacgacccaaggaccaagattcgattgagcaggagcagcaacaggaacccaataagctggcaaagtccaattcgaacgatctgcctgaatggcgcaaggccatcatgcggtctcttcaccttgggcgtggcaaccaatcgaagcggaactcaaaggactcggccatttcaaatcaatccatcagcccaacccaaatcgacccgtcaatacgtaccggggaaggccgctctccgtaccgtgacagtggcgtgtacccagaagacgaaagtcaccgtcttgtgcgatcagagagcatcaactctgcgagatcccgatccatggcaacgtctactcatcctggacttttggcgactactctcgcgacaccaagaggctcagtaactgcccgtcgagaaacattggagatggcaatgcgccgtcgccggaggagcagtgccgcccggtccggcctatttgggactgagggggtatatgtctctggggtcacactcgacgatgatgctgcctcgacgacaaacatcacccatacattcacaagtttcacgctcgagctggccgatatccaacatgctcacgcgatcgtcaacaactctgcgactccaggactattcaacttcaagcgtcagccacggttcacaatgtcgtccgtaaaccaagtggacacagaccaagagtttaagggcttcgattccgatggagatgccataagtggctatactggcgatgccgatgtgtcaatggaggataccctctttgtccggccaaagacgccagtgacgccaacgacatctgacggacgggacaagggcaaggcgcgcatgtccggaagctcggacattttgacccgtcggcgactatcaagtatcgagggtgattcagatacgttacctgagctgccggttctcactattcggaccagggatctgaatcggagcggtagcggtggacgacccaatagcgccaactctaatggacgcgaaagtccacgatcgcccaagcgagccgggactggctcctcccctactctcagccgtaaaccggctcggaacttcatgagtggctcacccatcgtcactgcagcctcaggatcaccctcgcccacaatactctcattggaggaggtcgtgtcatggaagccaagaaatatcttgcaagcagtgcgaccgccggtccctgccctgaacaccaagccgttgcccacagcacggggcagcaacctctcgacttcgagtaccttaattgcatcgtcgcgcactccttattcggccaccagcacgcagttgacacaatcaccaagcttcctcccgtcgcccacaggacctaccagaaaagggcctgagacgtttcatcaccatcggcaacagtcatcctcttcacattttagacatcctagccattatcagcaggcgtcctcggacaccttgattcccaaccacctgaagaactttagcacagcctcgacactgtcggctagctctggctactctgcacagacattgacagcacacagccccctgacggcgtatcagtctggtctccctctgcatcataaccagcctgtggtggagtttgatcccagccaggaatttccgcccacaaccccagtggacttgaaagccatggactttgacacgctgttaaaaactgctgaacaggaacaaaggaaaggacgcgaggagacgactctgaagaagaaaaagacctttcacagtttgagtcagcttcagcaactacagcagcagcagcagcaacagctaccgctcaaggttcaacgtcagattgtgccctcccatgatcttcctggcaacctaaggttcaacaacaacaagccattggctgtcaagagcagtctatcgactgctttgggcaagtctgcgtcgagtgtcgaggagctgcggatccaggatcctaccgcatatgccagcaagaacacggggtatagcttaggcaactaccacgacagcacaggtggtgtcaccaggaacaatggcttgcatgaccaagccgaccgtctggacccaagtcagcaacagcagcagcaaccacaaaatcgtcaatatctatctgcgcaaggaccactcagaatcacgatccccaaggtcaacatggcactggagacaggcgatatgggtgtgggagcgacaggtgcagcccgcaacaatccgcggtcgaggcgagtgatgaagaagaagatgagtgtgatcaaactgagcggcaatgtccagggtcgtcgcgaggacgatggcatgattcgagtgtcggtcgcttcaccagcgcgtggctcgtcttgagacctccatggtcttgtatatttctcctgagaaaaaaaaaagaacacccttctttgtatcaacaaatattggcaactgcggccaattgtaaataaaaaaaaaaatcacgcacgcatgtccaacgtattctttttcacgctcataatcgctgctgcacacttcttgaacattccttgacgtcccccctctctagagaaggttggctgcggggcctgacaaatttgtaagcgggcgatggttgggatggatgggtgacggcgaaatgtgcgccaaacaaatagatttttttttttttttgtgccctcgctcgatacgatcacatcccttgcctcttctttgtctccctcacccacacccacactcaccctacacacatacctacgccaataataccatgtccagcgctgtaagtgccagatacccgttgtgctgttggtgtgcccagctgtgagagcccagtacaggtgtggcatgggcctggaatcgagcccacgtttcgcatgcacgaccactgacttccatgccttgcgattcattccaagcagcaagaaccaacaagacacgacgaaagcgatcatgaggaattcctggatcccgatgaggtcgacgaagagcagattctcgaggacaacgaaggtactttatttgaccgtactacctgatgccgtcttaggactctctatcgaccactacatatcagaccacccaccttcatgattatgcttcttaacactccggtgctcatcgttctcttttttttgtcttgccacactagatgatatgatggaggaggatgatgacgagaatggcgaggaagcccagcaatatgacgccgagggaaacccagtggacgaggatatggtcgagtttcacgacgattctgttcaaggattcttcacccataaaggtaaaaccatcaccccgaaccccagctcaacaaatttggcgcccggcgtccgcatggtcttttcttgttctttttgacagcttcagtcatccgagcttttcgatcctaacgtgcgatttgcatggtctctatccaatcgacctatagagccggtatacgatgtggcattacacccaatccatcagaacattgctgtcagtggaggcggagacgataagagttacctctggagactgtatgatggtgagcagctttacgagtttggaggccataccgattcagtcacacaggtagccttcagcgtcgacggcacctacgtggccagcggatccatggatggcaaggttcgcgtctggaagagtgagacgggcgaattcatgtgcgaactcgagggccctgatgaggtcgttgtaagtcccttgtcgagaaccttgaagtaatctagcaagctagtcgatcaggcgagagaaggctactcacacccccagttcttttcactctttccaattttgcgcgagtgtagtggatcagatggcatcccaagggtaacatcattttggcaggtgctacagactcttcgatttggatgtgggccgttccctctggcacgttcatgaacgtcttcaacggacactcgggccctgtcaccagcggcatgttcacacccgacggcaagcgtatcgtgaccgtttcggaggacgcctcgctcatcgtttgggaccccaagtctgcagcggccattcatcgtatcacatcggacgacgctcgattccatagcgatgtgattacgtgtctggctatcaacaaggacagcacattggccatgacgggatctgcggatggcacggccaagctgatcaacctgcacaacggaaacattctgggatcgtttgagaaccatacggatgcagtggagacggtcgggttctcggatcacttgaacctggcggcgacaggatctttggacggacgggtgaacatttgggacgtgcagacgatgcagctccgtaccacatgtgagcataagggacccatcatcaagttgcaatggcacaagacacagcccttgatcacatcatgctcggcggatcgatctgtgcaggtctgggacggaaggacaggacagaacgtcaagatttggttgggtcaccaggatgcggtgctgagctttgccatgaccgacgacggactgacgtgcgtgacaggatccgatgatggatgcgcattggtattcagaatgactgacaactaacgacaaagaaacgagttagcggagcgaatcaagttagacagatggaggatggtttgataacaaacaaacaaaaaaagcaaacatccaaaaaaaaaagtcaaattcatgtagaaactaaactattgcataggcggaccgaaataggtccggctttattcctcgttttcccttcttgcggttattttacaacaaaagcgcttttttctatcgttccgtgctttgctagcatggcggattgctctgctattccgagtcctcgtcgtccgaattgtggttcgtcttgctcttcttgacagcgcctatggacgaaagaagagtatgagaatcgatggcgataccacaccatttgtgcaacagccgttagagatgcaatggggccctggtgggcaaacttacctttcgcagccccagctttacgcttagcggttgccttgttgcccgaggatggaggggttgccgacgaggggacaccatcgatggaggtctttgtcatgtttctctccttggcctttgtgcagctctggcagaaccaatccacatcgggcacagcctgtggatgtggtgttcgtgtttcgagaaaagcaagtacacgatatgagtgcaatggtccagtcaaaatatccccccaagagaataacggtacgcaaaccaaaaccatgcttacctgaagtcttggaacagtgcactgcagatgcgttcccgagtcgcacttgtcgcacagcagcatgctgtcttcgtcctctgcgctcaagcactcaatgcagtgctcctcaacgtccagcacaggccacttgggcacgtcctgcagcttttcctggccgggttggcagagcaagagggtgtgacccatgccacagctggcgctcatcatgaccaggccctccatgggccggaccttatcaggtttggtcgaagacctgggctcgccctcaccaaatcccagctcgcaatggagcgcaccctggccccacgcaatggtgcagggctccgtggtggggatggcaaagagggtgacgttgcctcctgcaatgtccttgaaagaccatccattgagatcgtacagtgtgcgagggtacatccagggcgttccaccgccaccatcgcccgtgttcttccatttgccccaaagccagaattggtgctggcctatacacgcatcccaagacgaggaaatacagtggatcggcattagaggaggcaaaaagaaaaatcaaaagggcaaacaccgcctagggcgatttcataggacattgaatacacaaaccaaagcattcaagagacataccgtccagcgccatactgaaggaacttccacaggcaatcttggtcgctctcatgattttgttggatcccgcaaactgatcaatgggcatgggggtccagagatcctcctgcttggagtgacccagacggccataccctccaaatccccaactgtagaccataccctcactgtccaaagcgagcgtgtggttgtttccgcacgcaacctggacaatggtcttgtccttgaggttcccgcccacgagcacaggggtggtttgagggatgtgcaccagtcggttggactgctgcaggtactggccgttggtcttgttgccaagctctccaaactcgggtgatccaaaggcccagacctgacccttctccgagagaatcatggtgaaatcagaaccacaggccgccgccgtcgccttctcccgtccgaggctgctaatgtgcacaaaagaggtgtggtccttgtgatggtcattgcagagctggcccatcttgttgtctcctgctccgtagactgcgccattctctgcgaccaagatggagtggttccgtccaacctagtggaggcgagaggaaggggtaagaaaatagacagtgtcaattatggtaccattccgggtccttttccaaccaagatgagatgaaatgagatacgatgaacgaaggagggtgtatggaagaagaaaaaaacacgccttacagctgcattgacaaacttgaggttcgtggtcttcttgccagcagaagtgtagatagtggggaccttcacgggcacagcgcgtggagcagtgtcgcccaccccgagctgacccttttcgttgcgtccaagagtccagacatctccgtcatcggtaataaagatgctgtgagcagcggagggaccggtgacggccttgacgatcttcaagtcggcgaattcgcggatgaggtggaacgtctccaagtgaggtagaatctcgcggacctctccagccttgggtttacggccgatcatgtcccagtctagaatgtgcagacgatagaggaagaacagtgcgattaatggatgaggaggtgatggaaaggaagcagcgaggggtgataatggccgggatattcaagtgccgttcatatggcagatttatgaatgacccttaccgactccaccagcaatgaggactttgcctagaagacatgcccgaacgaaagaaaaagagagtcgtagcgttagcaaggcgcagttttgaatcaagattgttggagatgtgcaagtacagtctgtatccgagcgaaacaaacgagtgtgcaactaagcaaggattgtctgacatagcattgctgtgtttacgaagccaaacgagacgcgttcagtgatttgattgttggtttctgcactggagatataaaacgtcacgcgcccgtcaggaaccagcacagcgggagctaagattaaggccgcatcagaccctgcagcctgtcaggaacaggcattttggttatgcgcgttgacgcgtttgataacagtcgtgcttgatcaagagccatcggtgtggaggtgctgaacatcgcacaaggacatagtcagcaacaacgacgagcccttgatttttttgttcctcttgttttttttttttttttgtcaacgggacgcacagggatggcgactagggccgaagtggagcgggtgttcaaagcgggcgagagcacgttggcgcgaggcgactaggaagcatgcagctgtgtctggcgagatgcatgggcacgcaaggcttttatttccatcagggtgcgccccgagcgcgagatgaagggggatgtgcgcgtgcattggcagcaaggtaatgctggggtctgcgcaggaagaggagagcgtgcgtcgcacggatgcttaccccaggtcggttggtcggttgttgatgtcatggcgagcgttctttttatatattctctttttttggtttgagggagaaatagacggttctgtgcaaaccagtgcaggccggctttgcttttctttgcggaacacagaggggcaaaagagacgaaagaaaaaggggaagggcaggccgtgcgacttccagatacctggcgtgattctcagccacttttttactgtactgccacagctgggtgcatcgtggatggcagaaagcaggcgcctgactcctaccgcactcagtgtctgtccctgcttggtgtatacaaaggtagtggacaacagctttgtccctagagtttgggaagcggttccgtattttccctgcaaccttagagtctatagcatcagtattaggcacgaggtatgtagaagacgtggcgcgtttgtctagagggtgcgaacaagctcaacttccttcccacggcagtgtcaacgctgactcacagaccaaccagcagacctaacccgcaaaatgcaataggccaagaaaacagcgacggatatagaagtatcagtgccataggtcataggcaggtactgctcgggcctttgcgctgctgctgcgctgtcactggaagaaaaattgacaatctcgcagggggggcccaacgctgaaagtgccagttgcgacggcgtatgcgttgagtcagggtgagagaggacaggatcgcccagtcgttttggtggctctggtgatagcattggcatccaggggctagcttgttgtcatggtttggcatgacaaagagatcaaccagagggtcacaactcacaagcgtctaccgagtacggcgaagcaagtgccgccacaactagggctggacaattggccattcaccgagttctactttttttttttttatgggtgaaatcggggaactgcaaatttttcgctctgcaccagtcgacgttgagtcagccgagtgcgagtgcgagagagcgcgaggccagcagcgcaaggccaactcaaaaaaactactcgcggcggcctccactgcaccacaggcactgcttcgcactcacggctcgcccctggggcccactgagggcgactcacacccagatccacacgcaggttgccctgtccaattcgtccagatcccccacataaaaaacaaagcggcctgtcacagcctgggatccattagagtttgcatcgcaccactcatttgcctatttcttgatcccctcgttcttggcttctttgcccttctttcctcttctctttcttctctctcttctctctcttctctcgcttctctctctctgctcttcacttctcctcgtcaccatccataactcctccccatacctctcctcgatccactatgaccttcgccacccccaccaaccttgtccccgcccagggcgctgccctctccgctgcctcggaggtccctgaggtcgcctccttcaatgtcaaggccggtctcgcccagatgctcaaggtaacgtctatccgccaagcttgctgctcggacgagtgtcctggatcaggatcaggggatgcgaatccaacttggctgctgcatgacctgacctttcttttgctctctgacttttgacagggcggtgtgatcatggatgttatcaacgtcgagcaggcccttatcgccgaggctgccggtgcctgcgctgttatggctctggagcgtgtccccgccgatatccgcaaggacggtaagccaaagaaagaacgcattcgcgcccttgttgttattggaggacgatcctcggagaaaaagtcgagatgtgatctgttattgactcatcccaatctccttctcatggtccccccataaattgcaccatccaggcggtgttgctcgtatgtcggaccccaggatgatccgcgagattatcaacgccgtctctatccccgtcatggccaaggtccgcatcggtcactttgtagaggcccaggtaaggagaggatgggcattcattttagctacgagagccaaaatcgttaaggtctacagcagacactctcctggattatttttctttgtcctaagctaacgttacgcaacggaacgtttcactctaatggtccagatcatcgagagcttgggagtggactacattgacgagtccgaggtcttgacccccgctgatgagtccaaccacatcaacaagcacgaccacaaggtccccttcgtctgcggctgcaagaacctcggagaggccctccgccgcatcaacgagggagctgccatgatccgcaccaagggcgaggctggtaccggtaacgttgtcgaggctgttcgccactgccgcaccgtcaaggctgagatccgcaaggctcagctcatggatgacgctgagctctttacctacgccaaggagctccaggcaccctaccacctcctcaaggagaccgccaagttgggacgccttcccgtcgtcaactttgctgctggtggtgttgccacccctgctgatgctgccttgatgatgcagctcggatgcgacggtgtctttgttggctccggtgtcttcaagtccggtgaccccgccaagcgtgctcgtgccatcgtccaggccgtcacccactacaaggatcccaaggtcctcgcagaggtctctgaggatctcggagaggccatggtcggcatcaacatctcggacattcctgaggagcagctctatgccaagcgtggttggtaaattgcccccaccttgtatccctctcccaccacttcccaaacactgcacagattgcggcgcgcaaaaaaaacaccacacccccgacatgtatatcaaaaaaaaaaaggaccaggcgcggcccattagaaagaaccacccctcgacatcactcattcacatcttggactttgtaataatatgatcacaataaatacgtattccagtcaagaaacttgcagacgatgtgaaggcatggttcagcacaccaaaagcaaaaggacaggggggaggaccgtcgcgcatccattttcatgtgcaaaccgtgggaaaaccaagcacgttttttttgtttttgtaaacaaatttgagttaagggcattggtgtggggtaagtccgctaggtagtgaggctgcaggcaacctgcctgcagcttgggtgcagacgcacatgcttgtgtccctatttcagcgatggccctaattttctctactcctggggggggcaatgtggaatgtaaagcgaagagcgttgactgttgcactcgaatgacgttttcaacggccttcactacgtttgtataagacagaaaaaaaaaatgcatagcactatttctctgtcagacacatagatccaagacatgccctacaaagacatcaaaaggcttccagaccccgggcgagcacatctgcccaagcacgctcaagaaatttaaaaggaggcgttcaacaatgcttgggacgagtacaaggattcggaagatcgccgagacagctcctcccgggagccaacccgctcacaagatcgcctggtctgtggtcaagcgctcgtatgtgaaagacgataactccgggaactgggtgtccaagcacaagaagtaaggttgaacatacccttgcagattcgaagtgtaaataataaaaaaaaaaaaaaaaaaaaaaatatgacacgttgtagtgaaaagaggaaataactgttggcacactctgaacttgaggtgtgatgcaagagtcttggcctctgattgacaccgccactcctcctagatgacgcgactctcggtgagctagcgacagcatgccagtagtaaatagcatcaatcaaagaaagggggagggcgcaggcgtctaagggtcgaggcccgcaactttacaggtcacattaagacagtgtgtaatccgttacagtggtagagagcctggctgcattgcatcgcgaactgacaagcgcgcaactgttgaacgctgtatcacttcatgaattgtcatgcgcaagttttcctgaaccaaatcctgcatgattttttttttaggtcggcgcgtgcaacggttgcctgtgcaacggttgcttgagcaacgtgcataatggacggacggggcgcggctgtagacaaaaagtgctcaatgaaaaaacaagaaggaaaacgcttgcagatacaaacaagaacgtagtaaagtgccattgtgtgttacgaacacaaaattgcggcgccaccatcaccaccatcgccacgcctcagcccgggctatgaacgcatgaccatttggttatcttttcgtgcttcaacaggttcctccacgcttatcccatgagcgagggctgcaagtcgacgatgagaaggggcgtgcgtttcagccattctttctgatccagatgatgggagaaaaactcgtggcaggatcgggaattgatacaggtgaggatgcagacccttcattgaacgccagatcgcaatcagacgttgccactttaggcgcctcctccctgaagtctgcgcctcgtccgttgcagcatcgaccccgatgtacagtgagcggctcatatgtaccgattcaggaaccgttggccaggcttcaagtccgatgcatgtatcgggtcggagagtgctgcactgaacaccgtggtacagaatagatatgaactgcacatgcatcgtggccattcgtcgagagtgttgcgattactaggttacaccacatcgggtactataggccatttttgacagcgtccttttccctagacctcatctactcggacacacagtcaaagagtgtgatgtccatgctgccccgaccatgatatcgcactttgtcatgcgcgatattagtgccgccagatcccagtacaagcccccggagtccctcagtttttttctcagctcgggcatgaactgatcctccattctcatatctttcaaggcgtataaaaaggcactgcttccgtccccttctccgttctcaccatcatcagcacatcagtctctttccacgcaacactttcccactccaacctacaagtctcatcgtaggtgtacaaatgcagccaggacactgtcccagcatccctagaacgtgcattacgaatttctaaacaccactattgagctgacaagacccccttcgcctgtcctgatccaattctagtccaaacatgcacaagtctctggtcctcctcgctgctttcatgctcggctctgctgttgtccagggtgctcccaccaagggcggctcctggtgcaaccagcccaagaacgagcccttctggggtgccgccacttcttcctgctgtaacggctggatgggtgaggatcgccgctgccacgacatccctgactgccgtgctttctacacttgctgcatcaacaagtaccagagcgccaaccacgttaccgatagctgcaagtaaaaaaaaaaacaaacgggaggggtcatggttcattatccctcacccaaagggcaagccgtccaagctgttcttaatgccgcaagcattagagtcgacaagaactaaataaaaaaaagaaaatgtaatagatccatgttatgcagaaaaccgaaacgacgcgttttgcacaaacatttgacgcccccaatctccctcctacgcccttgcactattctttgagttgcataatgacatagctcgcccttgccttccctcaaacacgcgacatttcgcattcttcccgattgcattccttttttttgcaacccggtccacttcattaccttacgacacatctccatcccccccaccccccgctcagcttcgcaatgtcgtctctcttctatctccgtgctgcaagcatcctgggtaaggtccttacctggctacagtgcagctcactactacaagtgccgtccaagacaagaaacggatattaacacgggctattcacttggaactctgtttaggcggcgttggtgtcttggctgcagcctatggtgcacatggactcgaaaagcgcgtcaacaacgacgttggaaagctcaaggtaagatgttagcctcctcaagaccactatcaccaccacacgcgctgctttttttgtttaatcgcaggagaaatacacctcttgcgcagcacactatgagaaaccttgttgattcaaaaagaaaaaccgtaacactcaaatgcgcgctgtttttttcttgtcttttttgtccatttttcgcgcggatattgcttttctgttttttttttttttttttgcgcgttaacgtcccctaccgaaaggcttggtcgagcgccgccaacatccagttgatccacgcagcagcactcctggcgatctcgcagtcgcccgccttgttggctcgtacgagccgctatgctgcgccgttgatgctcgtgggcacgaccttgttctcgggatcgatctacgcccttatcctcgacacggaaaagaaaatctcacgcgccctcaagctgggacccatgacgcccctgggcggcattgtcctggtggcagcatggggctccttggccttttagagtggcacggacccgagagccagtggataaactcactgcaaaagcgctcgacgaaaagaaaaggaaatgtaataaactgtcgacgagaacactctgtttgctttactctggtgtgagtggaattgggatataatcgcagtggatgtggtggcaaaaggatgtgggtcgaggctacagagacatgggcgttgcgccctttcctccaccgacagacactgcctggggtcgctctggtatccggataggtgccatggaggaggatgaattgggggttgaggtcgacagtccatgaacatggtgatcataggtggatgggatagggctctgctgtcgctgtacaagtacgggcactgaatgctccttcacaagaccgttggaggtcactcctgctggatgatggaaactaggtgttgccgcgttgcctgcatgaacagatccttcttcctgctgtcccatagcatggccatcgttacctccattgggtcgtccatggccttgattagaatcgggtttgtcatggtagaggtcacccatagaacgcgatttcttgaccttggccttgaccaaattctcacaccgcttcaaaatgtccttggacgacaagtccgtggaggactctaccagatcctgattgctcaaaatcagagacaggtccgccggtacctatatcgttgacaggattagcggtcaggcaaaaatctcccgactttgaaaacccggaaagcataaaaaccaaagtgggcgtggatgggcttaccacacaaaaatcgtcctggtattccagtaagcccatgacagcctcgatcgccagaaagctctcatctttgataggatccttggatttggagtagaggacattgggtgtgatgacagtcgcaagattgtgaagatccatcttgctgcccgtttcttcatcaatatgcgaaaacgaggcgacccagcgcaagaaaaggcagatggcctccatactatcgcggttcgctttgggcagcagacaacatgtcagatgtaagatcattttccggaccgcctcgtcctccatttctacaagtgaatgacgtcctgcagattagaatgataaccagccgcattgcatcctaaaacgcctacagattcctttaagtgtagatattgacaagcactcactttgagaaacgacaaagagccgatgaagcttgaacgtcagaatcggatccggcagctcgcgcagaaactttttcagcagcgctgcgacttgaacgggattatcgtctgtcaagttaactgaggacgggtccttatcgatcgcctcgcttagctcctttaatcgccgaatattgccattcttgcggaaaactccctccacagacatgtccatgctccgcatggccgagatactatcatcgacaaagctgggtatccgaatccgaccaggccctgcccccagtgctgagtccactccattgcgctccaccaaaacctcaaggggtaccccgaaagtaccttcaactagcagaggtgttaaaaaagtcgacgaggtcattagtgttaaaagttcaacgtcggccgctccgtctcagcatcaaccaggcagtaccctgctcaccttttggtttctttttgtctgttttgaggcccttgacaaatcttccccagagcgtctgcttgcgctgtccgattaaatccaggagctcctccagcgtaaagtattccgacactacgggtgctagcgtcaaaacggccaaatgcttaacgatgaacagctccagggcagagagctcattcaagtactgtctctttggatgacgtgaagcactgacgctgctcgaattagggagatgttgtgagccctgcagagaggcgtggcctgagcgcgctttgagcgatgctgtgggcgatcgagtggttgctgtgctgatccgaaggcgctcagtcaggtccgagagcgtagctggtgcatccgcattgcgtccatccatgtttgcttggtcctcctcgtcagtcagtaactctgattcatcaatgatctcgaactccagcatggacacctcgccctccacaggaccttctacgccgtcattatccacggcctcctcgtccacgtcgacaccaccggttggtggccgcctccgctggtgctcaataacagtctgccttcgaggaaagcgtgctgaattggagagctttctgtccaaatgcgtcgactttacgcgcttaatgtctcccagatggatggtctcgtacagccgattgtcatcggaagaatacgactttgaacgcgaatccttccttacgactccctgcagcatcagagggttggtggttgatgtgacaagattccgtcctcgttgctccgcagcctcttccagcgcctcatcccctgaaacggtcaaaaaagatgcaaagttaggtgctagccatcaaccataaggacttacagagcagaacatatcagcttcgccatttaccttttaggtgtagcaggttttccagacgaattagcgccacacgaagtaagaaagtgtactgctcgagttttgtgacgtgtgagaatcccgtttgcgactccggcgtcttgcactgatgacaaagcactgatacacggcccgtgtcaaatgacgcgtcataatagactgcggccaaaggcttggtgcaattcgagcagacgaggcatttgggatgccagcgatggtgatggtcaaacgtgaagcattcgtcctcgatcgttatgcgacatgaaaggcaaaggtccgatgtcacatcagcgtccatggtgccttttccgtgcaagtcctgaagacacttgtccttgttggcgagctccattagcttgttaaggaaccgcgcaatggcagtctttgactgataatggcgctccagcttgagtgcacaggtcaaggcgatgcggatcaggatctttaagtagtgagccagtcctgtcacgagcgagagtagctcttgtgtcatgccaagtcgacgcacgccgctttcctgtgtatgtgataagagcgagaaaaagttgacaattttcttgcacagcatcttggcttcgcgtccgtgtgccagatctatcacatgaagagaaaagagcgccccagaggacgcacgtctgcacatcagtatcgctatttttaaagagaaaaagctgcggcgagccggccctccagatcaaggacagtgataaaaagcatttaaatttagatagactcccacttaccattctggtcaccgacctccttcatttgagcctccagatcgtcgatggcgcagaacaggatctcgacatgcagaataaacttttctgccatttgcacaccgtcgtaatatgcaccgttggacacgtgaagtaacatctcagagatgcatcctgccgaggattcctcaaacgccgatagcactgtccagatctggtatactttctcctccatctgctgctgggcacgtttgagttcctcaggtgttctctgctccatgctcgcccgcgccgaaatcacttctggagaaatagggccgttttcttcctgcaggtcgatacgcgcctgctcttcctcggtatgtggcgtaaaggataatttgacgttccaaaactataatttcaggtgtgcgacgcgagaacggtaggacatgtcagttgtggctgtcaagtgcgggggcgcgcatgtcatttttgagcgcagaagaacagaaaagaagaaatggaaggcaaagcctgagggctgtgcaagcagacaataggtcacgatcccaagtttttcaaaaaaaaaaatacaaaggcactcttgtctgggcaccaatccaacggcggcggcgagaataaaggctgtctctcgcaaattatagaacccaccaagaacgctgcaaatggcataccttgtggatcatgtagcactctgggtgccagtgctcatcctgactgttgcggttaatctcgacaaactgcttcaagatcgcggtcctgcatccagcacacttgactgcataacacaacgagtaatggtagtggcaaaagaccttgccatcgtgctcataatatgagtcttgtgggccaaataccgtcggacacacagaacaagtaaagtgctcgatgtggtacttggtgtcgagcgccgtgatgtagcttccacgtagagcttcgccacaggcattacacaccaagttcagacgccgaaagtagtctcgttcacagagcggatgctgcttgccgtctgcctcggtgataggaaagaactttgaggcgacaatttgctcgcaatcctagacgtataccatatgcgtcgttagggtcgcgatccttgcattcacaacaagaaactcgactggacatgtgctattttttttctttttcttactagacatttaaagcaatcaaggtggaatgtggcacccagtgcacggacaaacgacccctgcatctgcagctcacatttgccgcacttttggactgcaggggctagctcaggtggcggtgaagatgaggacgtctggacgggctggctctgcaggcgaggctgattcgtttgctgaggaaaggactctgaagccagatcccgcgaggatccctgctggtgctgtaggtgtggctgttcctgtgcattatgcggtgtcactggtggtggaggtggtgatgacggtgctgcaggagtgcttgactctagctgatcctggggtagctgatgaggcatggcgagtcgtgtcgtgtcgggatggatgtcgggtggggtggccaggcggtgctgacgactaggagagcctgatatgccgccacttttggttggatagcaaggcgcctggggcggatggatggaaggttgtggagagagagaaaaaggatggcacaagcaacaaaataaaaaaaaataaaaaaatgaaggatggcagcgaggtgttgggcgaagaggagacgagaggacgggcaggagtgtggggcaagggcacgcggctaaaggctaaaggcaaagaaagggccaagggcaaacagcaagaaaaaaaaggcagcgggggcagcaggcacgaaggcggactgggcgaatggggcaggactggggcagggcggagcaggtgggcggatgcaggtgagggcgagcgagagtcaggccgagggtggaaatgcagggcaatggcgaccagagcagacgcgggtcgagtgagggtggagtggagcgggaacaagaagaagcacaggagaagcaggaccgcaacaacaaaagaagggcgtgcgagggagaagagagtgcgagagtgacagcgagagacaggaaaacgatgttcctgggtgggcaaacaagctctagacgataaaaatagtcgatggtcgccacctgtcgacctcccccaccaccaccacctcctcatcctcctccctcgctctctgtgctctctctctttctctctgtctctctgtctctctgtgtctgtgtctgtgtgtgtgtgtgtgtgtgtgtgtgtgtgtgtgtctgcgcctctcttttggaatgggccttttggacattgcacattcatccccatgagacctggcccaaccccgccgtgccaccgtgcttttctcaggtctctctgtcggaaaaagggaggtggcgcgtgaacgacgtcttttatattgctctctgtgcctgcacctgagcatggtagtccacgcggagagcacagaagggcacgcgccaactgctctccacaacctggcacatgtcaagcgacaatccctcgctccctcttggctcggcaatcaatgccagcgtggacccggcgctgttgccgtggctggttggttttgctaggaatggtgcagcaacacgggtcgtcaaaaaattgcaagggtccagctgccaaaaggtcccccggttccctcgtaagactgtgccacgcatttggtttctctcacattccttgcccaccctacacgaaacactggcgaaataaactttgcagcctttttcgggcttggtggttcaagtgcccagcaacggagcgactttgcccaacctgcgcagcgtcgaagccgttgctcagcgtctctaaatatggtccagctagagaccgatgaagcaagtttttttgtctttcgcgtcgtgaacctattggggtggtgtcttggtcaaggagctccctcgttttttttttctttgttgtttcacagatttttctctttttttcttccgtctacgcgcgccaccattatggggcagtcagcctttcttttgatcgcgcacctccttgctcgcatccatcccttcgctcttgcaccgaccgtacccccagcctgtgtcacttgtctcttccttgacactctcgtctcctgcagtcttcgtgagtgatcttgcaaagcatggctgtccgttagaccaagtaagcacagcggcgtcgctgcagtaagcgagggtccatggagattcaccctaacgttcagatccccgaccaacctagactccttgcgcttcgaacaaacatgccaggcagtcatccttccggttcacctcttggtgcatccagcagcaccacagttgcagagcaaaacgcctctcagcaacaacggcaccaagaccccaactctcaccaccctgggtctttagctcccacacccgacagcgcgctgcccgaatcaacatccgctccctactcgagcttgaacttgagcaacacccagaacaatacgatatcaagcactgctactaccgcccctcatcataatcataatcataatcagaatcacagcatccgttactcacagcttgaaattgacttggaggcccagttctcagagtttgttcgctcaacccgcaggaatgcatccagcgaccatcctgtaatcgagtcctacgtcgacaatgaagactatcattcgctcctcgccgcagtatccaacatccacatgtcacggaccgggacatacacgacgagccaaaccgacagtggacgagagaccgtgaccgcaaccagaggcatccagcgcagcccatatccctctcaagaaggccctggcggactagatgacggcatctctggaatggacgaggacagtgaggatggctacatggatcattcggacagtaccatagaggatctgtacgaccttcaacacatcatggtccataatcagcgtgagtttgaggtccaaatgcgccgtgctcgtgcggattacaaccgtcagcaacacaccggagcgggagccatggacggcacttacaacgctgcaggccgttctattgaatcttttctcgagttgccgccaagcatcccctcctcgacggtcgccgtgtttgaagctggtcactcagctcatgctcaccatacttctgccgagtactatttgggttctgccgtccagctcaggccaagcatttcatcatcttacttttcgcccatgactgagtctaccatcgtgttgtcttcgccgcctcccggccgagccttgagtgttgcgaatcataaccctacgtccatctcagtgggcacaagcacatccacggagcgctttggcaatggaccataccgacctttcgtcaccgggaccgaaatttcaacactacaacagcagcaacagcaccagcgacttgttcggcatcacagccccatagcgctgaatgctcttgagctcacgaatgaggagttgaatcttcaaggaggtcgtgtccttgagggtgagagtggagcagggcactggtcgacctatggatccgtgatacaatcgagtcggtcgtttgaacagcaccgctatcagtactatcgccggcagcaacaagagcagcactcggagacaagttatcgtcatcgccaatccatggaggacatttcgtttgatggatcgtcaacgttctatcatggagcagccagcccaaatctgcgaacgcgtccaatgccctctcagtcccacgcacacccttactggagtcagtactacacgcctcacccgcgtcaattctctgtaagtggcggatccctaatgagaagcagcatcccgatcccttcgcgctacctgagatctcaaccgttctctcctccatatcacaccactgctctgccatatttgtcctcgcatttgaccctccctcaggacgttacgactggacagggttacagccatgggtaccacggtccagccagtggcatggatcatgggtcttccggtgttgctaggcagcgtgcttttaatggccctcctcagacttattctgccaccgtggagcgagccgaggcgggcggttgggaccaaccctcccattcgtcggtatcggatcatgctccttcttggcaggacggagcaccagacgttcgtggtcgtcatcacatcggtcttaaagaggttgtcaggatggcctgtcggttttgcgagtccattatctgcgagcgcggaatgaaggtattcttcgaccgtggttcatcatggcactgcactcgtagactggtatatctaacgctttagtccatgctgaccctcgataggcccagctcttggcagatcagagcgtagcccttttgtcaacagatgatgctcccgaatcgtaggtgtactctgtttatttttaactttcgtttttttgagcgggaggggggtcttcatcatttgatctcactctcaacccattgaccgacatttctttcggtcatctttcaaaataacacgacgcagggtgcagcttgtggggactgactacagacccacgaactgctattgcaagatccgcgatacagcgtgccttgtctggtaagttatggaattcgtggcgatgagcgttgagtgactttagcagaattaggaccttggtgagctgaatctagatcccattcactttatgttagtggtaacgcgattggctaccacatcacccagccctgcgaaaagtgcttaaacgccgagaacaacggccacctctggcttttccatccagagtacatattgacttgtccacgcctggatcctgtgtgttcgagacccctccgctggaaagagctgcctgaaccagaccaagactatgaggctttgagcctcggaaaggtgccacaggggggtccaggtggaaggttggtcattggtggaatggttcgtcgaggttatgaaaacgtttgcagatagaaaatgaattgattcttttttgaaagctgcagattcagtttcatcagatcgccatggtccaccaccagctatcaaagcgtttgaggagaatgtttgaatggatggtcagcgtggagttttagagtctatgaaggtcgaaagcatggggagtggtaaggggggttgtttgagagaaggatttacaacacgccaaagtgacgcgcgctgacaaggaaaaaaaaaaaaaacgcgtaaatgttggtggcgcaagtcacatgatatacaattgtgtggctttttgtggcttttgtggcttattacgcagtaccttattagtccaaaatttattttcagtcatctgactttgttccctgtggccaagttggttttaaggcgccgtgcttatattttcacaatataccaaagacacgcggagatcccgagttcgatcctcggcagggaaaacgttttgcgtcttgcgaaatgatttttgttctatggcacgatatttttcacttttccatgctcctgtgcctttgttttttttcctttgtctatcgcaacctcactctcacacacccttggttttttctggaaggatccccagacaataacccagcccgatggagtgcggaaatcctcagtaccttgaatggataggcgaatggatggagcacgcgcgtgagaataacaatcgctcctactacatttatcgcaaggtaatccctgttggcaactttttttgcagcagcaggctgaggaatgtatggaaggtactgcaactgaggctaaccctgctttcctattttacaggcttatgaatccatggcaaaatacccaacgcgttttaaccatccaatggaggcaatgtgtttggcagggatcggcgagaagcttgtgggcatgctggagaaaaagttggcggtatattgcaaggaaaacgatctgccaatgccaggtatgcctcaccttcgtgaacagcaacatcgttatgtttgatgagcaagctcgtccttcagcgactaagtcacgtcttgacgtgcacctttgtagcattcaaaaagcgaaagccaaccaaaattggcgtggccgacgacgacgaggaaccaaagccaaaaaaaccgcggcaaaagagcaagccttacgttccgacctacagatcaggaccttacgctattctcctcgcgctgctggacgccaaagaatctaacggcgaagaatgcctgacaaaacaccaaatcaccagtcagggccaaatctattgcgacgcatcacttacgaacccagagcatggcaagttctacacggcatggagctcgatgaagactctgatgggcaaaaacctggtctaccagtccggccacaagtactatctaacccctgaaggcacctctattgcgaagacgatgaaggaagctgatccagcagcggcagcgtctgccgaccgcgatgaacctcaagagaacattcgcacgtcaacatctccaaggagggcgagaccgagcgacacatcggatacttctcataggccttccaggccggatgccgatcgtcaatcaagtagcacttcaagcttcaaagcaacaacaagtcgttcgaccacttctgcggacgcgcgactgtcatcgcctcatcgctacgatcccgacgcctacgagggggatgcaaacattgcactggactactcccacatagaacgaaggctatcagaaacgcgcacggttgctcgaacacacaatgtactgtcatcctcagcctcgtcctctcggccacctcctgccatagcatcgtcgtactcgtccatctcagcgcgttcagttctgtcagccatcaaccaacttggcagggacgagcctcttaccatctttaacgtttccgacgatgatgacactggcgttgagtctcttaaaccatccgccacaggtgagacaagtggcgaggcgtactcatattcaaggcagtacgcatcggtgcctcgaccgcgattaccactaaacggggctggagcggcatcacattcttatgccggtatggcggcggagaaatcggcatcaggtttgccgcgccatgcatcggcgacatccttaaagacttcgacttatgcccgatctagcagccttgttggatcctcggaaggaatttcatcgatgcccaaacacaatccattcacgcacctatcagagtccacattggcacggtcaacaactgccagtaacgttgcggcactcaacatcgagaaactcgcaagatttcagcctattatctttctacctggaacctttgatatccgccttgtgctggatatccgtgaggtccgaaccaagacggaccgcgactacattgggcaaaagttgacagagcgaggtatcaacgtcagcaagcgtgttttggaagtaggcgatattctctgggttgctcggctgaaagaccctagcccttcggggccggatgaaattgttttggattatatcgtggagcgcaagcgtatggacgatctggtctacagcatcaaggatgggcgcttcaacgagcaaaaggtaatgggtcggagaatatgcgcagctcgtcgtgtcacagcaaagactgatgagacttacctaagcgcgtctcctctagtttcgcctgaagcgatcagggctagggaaccctatatacctcgtcgagaccttcaaagtgggggaaacttatgatattggcgcagatgccattcgaactgccatggtcaaaacgcaagtgcaggacggattctttctcaaacggactgatcacaccgaccagacgatcgattaccttgtcagccttacgagtgccctgaagcgtctatacgaggtacattattgacaatgctgatatccttgaaagacgcaccgtacgcttgcacttgtgacccgtccttgacttcactgacaccctctccctctgcttctggcatcctgctctagtccgaaaccctctatgccattccagatgacgctgtgcgccgatcaaactatctggagctccaagaccatctgaaagagaaatttccagatcgcacctacctgacgagctaccaggcgtttggatcgctcaatggcaagtctgacacgttggctgtacgagacacgtttgtcaagatgctcatgaccatccgcggtgtcagcagtgagaaggctgtgcagcttgcacgggcctacggaacaccccgggccatgttttcagcattggacggggccgaagatggtagaggcaaggccaagaggaagtatgttttagcgcaaactaactctgctgtcagtaggaggaatatcagcgaagggctgagtgccaagatcgcggaaatttggtacgctgatgaatacccagactcatagatggcattcatatttatatatataccgtgtataccagatcgaagaacataacgctgacatcttgaagctcggactctggcttggcaaggcctcagtgcacgtacaatacatgatgcacatgatactgaacgtcaaagcgcgtccgtttcgccctttgattttatagaggttcagaatccatgtctatgcagcatggccacagcatatattttgttttttcctttttcttttgctctgccttatgtgtccccacgctcattccatccgcgcgttttgaccctcgacctcattgccccattgccactccccctactgctgatgccaagcagagttggcttcgctcacattcgcgacaatactcacaagttcatccaacgccatgctgacccagcacaaccttagcaagcatacggagcgccaccaccagctaaacgagaagagagactttgtcgaagaatatctggacagtctggatctatcggctctgaagggaccctctaaagtacggtgccatggtagcctcagcgtaggacaagagcctagcttagccgaagcgtccccgcagcccatcccgccccagcatccgagccagcaacagcttccacaacaaccacaacaaccacatcaacagaacaaggctaagcggaggggaacgcgcagtaaaccggagcaacactctgcggacgaagtcgttgcggccaaacctcattccaggaaggcgcaagagagcaagtcagctttgatcgagggcaccaagcgccgagatagcctcctgactgccggacaagacgagaccaagtcttccaagagacggaggcagtatgtcgaagctgttgagattgaagtccagaacctcgatatcaacgattcaaactcctctaaggcgcctttgaagaagagaggagggcgtccggttagagcaagcatcaagacgcgaagtcgcacgtccgctaagctaggtaccggctccaatgaccaattttccatgagctaatgtgctcgtttttgtagcagcagcatctcatatgaccccactgacatgattaaagccgtcaatgtcaaaactgtgaatagcaaggacgcgccgcagccgagaagatctactcgaattacagcctcacaacggcgagcgtaagacgacgtccagcaagaagccactaagaagtcggtccgagaaaaacaaccaaataggctgcggctaccggtacgctcgacatcatcaccgccgcccatcctgtggccaacgccgggatcaccaacgccgggatcaccaacgcaacgacctcaaagaactgtccgcaagtcgtggcaagtctgggaggtcagatagtaataaaccacgcaagatcttgacgcagggatcgctcatcataaacgtaagcgtaactttttgccttggctatgcatgcttgttcaatgcgcaacgaggacagcgtctctcccacagagttaaaaaatgtgccagcaaaagaactaacgagtgtttcttgctatcgcacgtacaatgtgggggatattcgcgatctacacgacatgcaccccagcagtttacgtcgccaaatgtttccagagaaagaatcacggtaaggccctgacaatgaagcgtactcttatcgcgttcgacactctcgctatgtccgatgatgacacttaggttgtttttaatctcgtagattgcagaaaaaactggtcggcctggtatattcagtaaagggatagcttcgcagaggactaccgttcacgcaggtaaaaatcgacacctttctcaacactgtgaggtctagggtcagcatctttaactgtctctacacacgtgcgtaggacacgacttttcggaaaaagactttttaaatcctccagagacttctgggttacaccggctcgatgatcaaacgcgtagtaaggtcgtaacatctgcctactttactccggcgcaagacacccgcatggacagggactccacgagtgatagatccaaggcgcacagtacgacgggttctagcagcgacagccactcctacagtgaccatccaaggcacagtttacccgcacatcgaggacgtgggcgtctgcctcatcaccatcgccattgccatcgtcagtgcccaaaggaggtgtcgctcaaaggctcttcgcaaaagtcacactcgagaatgtcgctatcagacaagctatcagagatagtctccttggctgagctgaatagccatcaaccttggttgagttcattgcctgaaggtctatcggcgataccgggctcggaagttctgacagagcaggccgagatgtatgagactttctatcaccaaacgagagcgtcgattgttgttctctcttgatcatgttgctgttgctaacgctcctggatgtgggctactaggattccgccaactgttgagctgacacagcatatcgatcagacaagctactatcccgaagccgagacgaccacaccccactggtatgagcaaaatttcgaacaagcaagcgcctataatggattgcaacaccctatggctgctgcgcaggacccatatgggcctatttactatgaacatggctcgttgggtagcatgttctatcaacctcaacagggccctgtcatggaaatggctgcgcagtggccgatccaaggcgccggccctttaacactcagccagcaatcttcagagccgtttgtcgagttggcagcgaatattgacgatgatgcacttgactaccctgctcgcttgtatgcgctgagtgcccagtcctcagcgccttcccagccccggtttcgctggcgaccccatcgcttatattgagatcgaataaatcacatgatgcgtggcttgcatgttttgatttttttctttttgtgagtggatgctccagggaaggggtcaaagaaggctcgcactgcttgaggtcgacgacgctttcgctctctctcctcagcctcgaccaagcacaacattacctgtttgtggaccgccttgtctttccgcccaaaatgaaggaacaagtgcacgagcaggcgccaaagaagatgtaaggctcttcactttccctcagaatcgcccatgcttccatgcctggatgccagacaccacgtcctgcctacgcctcgcatggcagaccctgtcgccagaaaatcgtattgccgaccaacaaaaagttgcatttgcaggatgtgctgcagaacaagaactcaccatcctggactttttatctttcacgttcttagcaaacatatccagtttggtgtcctttcgccgcaggaaatcgtcaatgtatcagagtttgaggtgacgcagcgcgacctgtacaccgtgcaggatcgccagcccgtcaaatatggaatgctcgacttgagactggtaagggaaactattgacttcggcaaccgcatcctgcttctctctccagcaggagcttgagcgagctggtggctttgatagctttactgcggcaagaggcagatggagacgagtcatcgttgaacgcctatactgacagtgcgctacgccatcatagggtacatccgacaagcaagctacatgcgagacgtgtgggttgaaacagcaggactgcatcggacatttcgcccacatcaggctgtgccttcccgttttccacattggatatttcaaggccgtcattgtcattttgcagaatatctgcaaggtaatgtcgagcgcgttctattttctgggcttcctacagatacattgtttgcccatgcttacaagagaagcagactatactgacatggttttcgtggattcgtcataatagacctgtagcagagtgctgctttcagaaaaggaccgtcgcacatacctcaggaagctccgtgcacccaacctggagaacctgaccaggaagactgttgtcaagaatgtcaacgacaagtgcaaaaaggtcgtctattgcccttactgcgaggcaacgaatggtagggacataccactcctgaagcgtactgtgatcagccttggaaataggatgcccaacttacatgatacggaactaaactgtcattctaggcgctgtcaagaaggtgggtgcactcaggatcgtgcacgagaaattcagagcaaagagagccatcgaggagtatgagcagttcaagagcacgttcaacaacgccattgcggctgctccagacatgaagccccatatcgggaaggcgcatgaggatatgaaccctttaagagtcttgaatctcttcaaggccatctcagacgaggtaaggagcgtaatcatgcgtaatggctcacctgaggttgaaagagagttcaaaggagccaggaactgcttggttgaccgcttacactcgatttgtgctgctacgtaggactgtgaacttttgggtatgaatccagatgtcggacggcctgagatgtacctctggcagaatatttcggtcccaccagtttgtattcgtccgtcggttcagcaggatggcgccagtaacgaggatgatatcacagtcaagcttacggaggtgattttcaccaacgcccatatgcaagctggactcaacgaaggcatcgctatacacaatttgatggtaagcacagggcctcactcctgttttcaacatggtccatgggatgacagcaaagcatatttagcagagtgttttctaaacatatattctggcgcgcgcttcatctttttcttaggaacaatgggactttttgcaactctcggttgccatgtacatcaacagtgaacagcccggaatttcgaatcttcagccaggaaagcccgtccgcggcttctgtcagagactgaaaggaaagcagggtcgattccgtggaaacttgtctggaaagcgtgtcgatttttcaggacgtacagtcatttcacccgacccaaatctgaggatcgaccaggtcgctgtccctgaacttgtggccaagaatttgacatatccagagcgtgtcaccacccacaatatcacacgtctgcgcaacgccattacgaacggaacagaggtccatccaggagcaaattatgtgacattgggatcgagcaatatgaagaagtcgctcaaattcggtaacaggactcagatcgctgctgagatccaggtcggagatcttgtcgagcgtcatctgaacgacggagacgtcgttttgttcaaccgtcagccctcacttcacaaactgtccatcatggctcattatgcaaagattcgaccttggcgtacgttccgtttcaacgagtgtgtttgcaatccctacaacgccgatttcgacggagacgagatgaacttgcacgttcctcagacggaggaagccaggaccgaggctattgagctgatgggcgtcaagaacaacttggtgacccccagaaacggaacgcctctcattgcagccattcaggatttcatcacagcgtcatacctcatcacgcagaaggacctcttctacgaccgagcacagtttgtccagatttgctcgtacttgggcgatgctgagctcaagatcgacattccaccgcctgctatttggaagcccgcccagcgctggacaggaaagcagatcatcagtgttctgctgaagcccaacaagagttccaaggttctcgtcaatttggaggccaagacccgctcatacgacaaggctaagcgacctgtcatggacatgtgcaataacgacggctacctggttatttacaacagtgaaatcatgtgcggcgtgctggacaagtctattgtcggtgacggaaacaagagctcactcttttacattgtcatgcgtgactatggctctattgaggccgcaaagtgcatgaatcgattggcgaagctttgtgctcgttggttgggtacagttggattttccatcggtatcaacgatgtccagccgggcgagattttggcagccaagaaggatgagctggtcaagaatgcgtacgctcattgcgacgacctgatttaccgctctttgcatggccagttggagaaccagcctggatgtgacattgagcaaaccctggaggcgctcatttcaggagagctttcgcaagtccgtgacaaggtcggagacatctgtttgacggagctgaacaaattcaactcgcccctgatcatggctacctgtggttccaagggtaagtacagtttctgcacgtaccccattccggtctttctattcatcgctgtctatggaactaaatgctaacatatgcgcacttgtctataccaacacaggttccaagattaacgtgtcgcagatggtcgcttgtgtcggtcagcaaattatcagcggcaaacgtattcccaacggcttccaggacagatctctgccccatttcttgaaaaactcaaagattccaccagccaagggattcgtccgaaacagtttctacagtggcctgacacctacagagttctttttccacgctgtctccggtcgtgagggtctggtcgataccgctgtcaagactgccgagacgggatacatgcagcgtcgtctgatgaaggctctggaggatctcaccacacactacgatctctcggtgcgcaactcggtcggaaacatcgtacagttcacatatggaagtgatggcttggatcccgcagtgctcgagggtaacggaacaccagtcgtgtttgagcgcaactttgtaagcactctccacattttgcctgtgaccaaagatgacaagcggttgctgccttatcagatcaatgcctatgccgagaaggctgtcgagtcgcctcgttgggccaagaactgttccaaggagtttattgcgtccgtgctcctctacgtcaagaaccatattgccggaaagttgcagaagattcgtgaggcatacgatatgatgtcaggagagcacaatccaggcgaggagtacgaggacatggacatggacgaggacgtgcccgaggaggtcaagaaaattgtcaacaacaagctgtcggtcactgagcgccagctcgaacagttcctgtacatctgctgggacaagttcatgaaggccaagatcgagcccgcctccgctgtaggcgccgtcggtgctcagtccatcggtgagcccggtactcagatgacgctgaagactttccattttgctggtgtcgcctcgatgaacatcacactgggagtccctcgtatcaaggaaattatcaacgcagccaaggttattaccacacccatcatcacaactcgtctcgtcaacaacatggacgtcaaagccgcgcgtatcgtcaagggaagaattgagaagactatgcttggagacattgccgagttcattgaggaggtatacaagcccgatgagtgctatatcggcgtccgtctggatatggaagcgattcggagattgcagctcgagacggatctggatgaggtcgccaaggccatcggagcagcgcccaagctgaggattggtgccagtaatgttcagtcgcacaagcccgatcgcctccgtatctatgtgcagtccaaggatccagctggactgtactactcgatcaaggcgctcaagagagctttgcctgatatcatcatcaagggtctcccgcaggtcaaccgcgccgtcatcaacgagattcagggcagtggtggcaagaaggagttgcttgtcgaaggttacggtctacgcgagctgatgaacactgagggagtcgttggaacgcagacgcgttcgaatcacgttatggaggtctggaaggttcttggtatcgaagcagcccgccgtaccattctggacgagatcaagagtgtcatggactctcacggactgacgattgacccgcgccacgtcatgttgttgggagacattatgacctcgaagggagaggttctcggtatcacgcgctttggtatcgccaagatgaaggacagtgttatgatgttggcgtcgtttgagaagaccacggaccacttgtttgatgcggctctgtactccaagaaggatgccatcgagggagtttcggagtgtattattatgggtatccccatgtcgattggaacgggtctgttcaagctgatcaagagggacgatgcccaggaccgcattcctatccgccgcaagctgttgttcgatccatagcactgttttaaagaaagaaagaaaaaaaaaaaaaaaagcacgcagcaccaagtaatgaaaattcacattttgcataagtcgatcgttgtggcataggtcctttgcatgcctgactgtataatatatagattagatcgtctggcggggcccacaccgacgaggaccaagtcaagggaagtgtctgatatacgcagagcggacaaattgatggtgtgctgattgctcctttggtgctccaactctcggtagtcgtgttttttcatggtggatgtcgttgagagtggataatatattcggctgtgtatttgtgccttggagtaaagcgccaaagcaaggcagtagtgtgtgctgcacatgcctcaaagcaggtcccacctgcattgtctgtcgcaggccaacgaagggcgatttgtccgttcagggactcgaagtgaaactcggacagccgcatcgggcgcaagtccttgcagcgctttgatttcctgtgacgtcatataaacgggtttgcactcggctccgacgagaaaagacgggttcgttttcacctgcatcaacactttcttcgattcacaccacaccggattattcaacatgtctgacaacgccgagatcaagatcgagactggtgcgttgaacaaataccacatctgcatctagtgttttcaatgttcggaggagggacgactgcaaatcgccgcttgatttacccgaaaaagatcaggatctcgcccgcgacctcatctatggaaaaataacaacacgcccgtgatggagcatagcacgggtcataagtggaggaaacaaaagaatgcatgcccgcgcgttacgagtcctcaactctggcggagcagcacttcagcacttttgccacacacgccagcactgcagtggccctcggaactgtaccctgcagcttgattttcattctaacgctttattatttttgcaattgtatctctcagctcccttcgacgctcgtttccccaacaccaaccagagcaagcactgctggcaggcgtacagcgactactacaagtgccttaacgctcgtggtgaggagttcgagggctgcaagcagttcaagaggaccttccagagcatttgccccaattcctgggtatgtgtttttttttctttttacttgggagattctctgcagcgttgataatctatctatagtcgacactaactggggttttctccgtgtatcgttttttttcttattgctaggtcgccagctgggatgagcagcgcgaggagggcactctccccttcaaggtcaccatcaccgatgaggcacctgccaagcactaagcttatcaatcctcttgtttgatgagtttttttttgggtaatggttgtatttcgcccgcacgctcgatatcaccaatagaagcagcttttcattttatataaaaacaaaaaaaagaacgagcaaagaaggacagtatgaattcctctcggctctttttgttcaaaaaaaaaaaagtctccaccttgtagcagaggattcgcgcatgaagttataataaacattctttcgaaagcaatggcgctatgaggcgagcgagcaccttcatggacattctatggaaaagagtaatgtctcttgttcagtacgacgcgacagtagcaaaggtgaatgtgattttttgtttgattggatatgataaacaatggaggtggatgtatctttgcctcaaatctccaaaggaacagaccctccggtgccatggttaaaagtcaccagaggtccaaatccagggcgatctgcaggcaagatataccaggctcctttccctcacaacagctgcgttcgtccccaaacctgtccactttctctcatgtttctctccttgatcgtcaagagcgactgcatccttctttcaagcatctacaatgcatgaattccctttccacaagttcacgcttcttctcagcaaaatttctgcttggcttttcttttcgagcgataggcctatcctagtcattgagcaatccttctccttatcaggtctgcaatgtcattgtgaagcccacctccttcaacaaaagacgtcctttccgtttatctgataagttgacagccccaccatgctgctcattctacctggtctgtttcaaagctccgtatgatcaaagagtattcccaaatgtaatatcatggcgttttcctttatcgtgcatctacacccatctacatgcgccgttttttttcgctgtcaactctcaaaacgagtgctctcgaccaccggcattgtgatcccgcctctgctgcatgcttttgcagcattctttacgagattcgacacatctcacctcaatcccttcgcctgacaatatactggatcaaaaggaaatctcgacgatcaggaaactggccaaaaaaaggaaataaaacaaggagtgtcggctatcttcgtgacaagataacaaacattggcacaagacaaacagaaaaaaagacaaccagaccctcttcagagatccaggcaagtagtaagagcaaaaaaagtttttctattcaggttcctctccccttacaaacattaaaaaagaggaaccctactaaaaagaacttataaagattgctccgtttcttgccagtatcaaatcagagagaatgtgtgttttttctcctttcaatgtcatgtatcaaagatgttaccgaaatgccactcatgaaagcttcgttctcgttgagttttttctttttcttttgaaaaggaaacctgaacggggagattatgatccagatccattgtcaaacaaagtgcgtggactgagcgagacatgtttcttcaagtaaagaacacgacaagaccatgagagaggtttttgaatgggacacaaatagcgccaaaaggtggatcacacaagttttggtatgagagtgagggagacgaaaaaaaagaggacacatgcgagatagataggcgaaagaagcagggagtgacaaagggtaataaccagatatccacattctgaaaaacctgatcttggagcgaggaaaggaaagaacacaagcagaacattggcgagcaacatgacaaaagagatcgaacttggtagattcgtgaaaagacacctcaagtgtcagaaagatcattagcagcacaagagaacaaggcaaaccttgtgtaagagtagatgtgttcaatggttcacaggaacagcgggaatactgcgaaaaaagaaaaacagaaattgaagcaagagaaggagcgcttgtgaactgaaggatgggaatgtcagactttgtggacaccggtgaaagtagaggcagtgcgcaccttggacaaactagaggaaacactatgcgagagaagtaaaggacagaagggagcgagttacagctgtcgaggagagggatggagtgctggctgattgtatctctctccgaaacgtttaacttgcagcgcagatgagaactgcaggtagcaaggtgattatgatggagggataaagatcaaaaagaaaaaagaaaacagatcgttttgaacaaaacaatgaaaaacaaacaacagcacgtgaccgaaatattgtaaaacgcccaacaaggttgtctgcacttgacgttcctcacagtacaaagttttagttctggtcgtactttgcatcgcatgctttcactcccgaaccccttggtcacacttgcgcaccacacagtattggctttgtcatcgtttatcgaaagaagatcattaggacagaagaactcgcaaaaaagtcagtcgtgtgcgcgctgaatgtgatcaagaaggctgccctgagaagaaaacaaaaaaataaattgttgagcatttttcccagcagtacgtcaggcgataccttcagaacagccagagccgtgtgctgttcaccctctggtgcgagctggaaagggcggaagaggcagcggttggccaggcaccctccccattcttcggggttggaagccacatggggcaaccttaaaaagcgactttctatgaaggcgaccgcggttgggtgtggccagttgtccccattgaaatttcatttcagatcgccccacaacaaaaaaaaaaaaaaagccattcgcagcgttggatacagtagcagggtgatgctagttcaacgagggcttccatccagaagggctctccggcacagagcacagctcgcccgagcaactagaagagctgttttgttgattcatgaagggctatatatatttccagggtgctcaggcaccatggtcgtgcctgggggtgtgctgagacgaaagctgccggccgcagcatcagaacgattctgaatcttgcgctgtgggcctctcgctgggttgggtgacagatgaccgacatgaccttgtgtacccattgggagatcgactttcaacgtctgacatgatcaaagattttttttctgtcttccccaaaacccaaccatctgccggcattgttggtgtgggccctattatgtaaagaagcactccccttgcttcgttgttccttctctacctcttgctttccttctcctccatcgcctctctctgtctctctcgagctctctctctcccccgcacactcacccttactctcttgctcactcttttcctcgcactcgctcgctcgctcctgtgcgcacagcgtcccactctcgccattccctcttcgtctttttttcttttttttctcttcattgtgaccttttaatactccgtccccaacacgccattgcccttacaccattcaaccgctgctcatcccttctctcgccattcagcactgttccttcctccaccctcagccgacaatcgtgccacaccttgcccgccacctgtcttcccagtcttcatacgtgttctcgtgctgtctgttcttgacccccaacagacttcttggccgcgcttccagaaataatttcctccagcgtgatctgcgctgacaaagtttggttccttcctacaacccgccgttccttcctacaacccgccgttctcgttcagcccacgctttcctgtcgcaactgtcttttactgctttgccccatccagcctgcccaccagagcacaagcacacagcttttcttctctctctcgcctacctcctgtctccatcgcgcttcgcttgtacagggcaatagctcaaacacgatgacgaccgccacaacagcagccggtgccccgacgaatccccaggcacctccagccttgctccggatctctccacagacatttcagttcacaggtacagtgagatcttccccgtccaaaatttgcacatcaatgcagttagctgaaacgaaaggccatgcaatttatgttctggcgaagcttcaccccttacattcctggcccaccccctcccacggttatttgtggtcatggtagctgtggtacggaccgtttgcaggtctgttgttacactgtgggcgatggggccgtgcatatcgattgggcttgtagccgtttgagttagtcgaactgacttttcaggcacagacacacaccacggtgtcacattcacgatgttcgaaatgcacgtccgttccaatgcaggccaggatttgagcggtttgataatgtgccgatcgccgtaccactatggcagacatggctacattgagtaggagatgaagggggggacaagaggagaacagacgagcggggccctcgcattgaagtgggtgcgaagacggggttgtggtgaacgggcaagggttcgctctgtatcagtggacaatgcgtcattaaagcggagccgggggacccacgacggaggaaaagtagccactatccgattcaaaacggcgctgccccaagctttcattgttctaacaactcttgcgattttggtatctctagcctccaaagtctcctcaggactggtttccaaactcaagatcaagaacttgttgactaaccatgttggctacaagttcaagaccaatgcaccgctacgctactcggtcaagcctgtccttggggtgctggctcctgggcagtccatggaggttttcggtaagactctttgtatttttaagtttgagcattttctctgtcaatcaaagatgtccaacatgaaatctgatcgcgatctgttgaatggatagtgcgttgcgaaagctgggtcaaccctcaagatagattcctgctgcagagcgtagctctgggtgaggaggaaagccaaggcattgatgctgtcactgtaagtcgaccgctgaagcattcactgcacggactgcacggctgtttgtccagcatcggacgaaaacacgcgctgtactaacgaaatacatccactttttatctctcttgatcattatagtggaaggaaatcgaccgacggaggatcattgagaactttatccagtgctcatcttcgtcaacgctcgccatgagggaacctcaggatgatggcggttcgctgtcatcctcgtcctccaactcgtcgaggacgaccgcatccgttgattcctccacacagtcctcaggtctctctgagaaggcaaggtcccagcgcccgcatcctgacaaccgtcagggccagcagaagcggccaactgtcgcgcatgttcacgcagcaggcagaaaaatgtcgaccagctcctccgtatcctccaatacgtcgtctcctggatcttaccccacactgttcacctcctccaaaggcggcgctccgtccagattgtccaactcctcggctccaggtctcgggcatgggtatctgacgacaaccatgagcaacgtgaaacatttcctcaggaccatgtctcagttcttggctgcgcgcaaatacacaaagatccagatgttgacggtctcggtcatctgcctcttgctcggattgcttctgccgttggaaaagatcttcatgtggtcaagtggagcgagtagcagcaacaccacgagcagcaacactcagtttcgaagtggggtcattcatcgaaagcccatcttttcctcctcctcctcgacggcgtcttcgggcatcttacccgtcatggtcacgactgctcaggctggccctgttgctgtcgccaaggaagcagatcctacagtgctgccgccgttagtggacgtcgttcctgaagaggtgccaaggccagaggtgtgggcacaagacgaaagcgtgcctgctgccagcgtagtagaaggcgctctctgaatgaatcgcacctcaaaaaaacacgtctgcgtcctttcaagatctttcatagtcgtcgtctccatcaaatcgtcattaatatcgttcttacattgtacaacactttttctaaaatgaacaactaccatcatttaccattcgccatctttttctcgacgtgtgctcactctgccttgtgtgtattgggttggtttttctttaatggtgcaatcctaaatgatcccaacgatgattctttctactcgtgcgctgactttttcctttttccctcgtctcaggaaaacatccttagttgtcctctccaatcttgggggccaggtagtagcggatataaccggtctccatcttgtactcaaccaacaatggcacttcgctcgacatggacagggagacacggccagacaatggggtggcctttgtgaagttgacgaggtacttgagcgagaagttcagggacacattctgctgcaactcgatcagggtcgaatcatcctcattgtcaacattggcgctttgcttgagcgtcactgctcctgatccgagctcacccttggccgcaaacttgacaccttccttggtcacatcgatctggacagagtccgaaagaacctgcaagtccctgcagatgcgcgcaaactcggtcgaagacatctgaacaacagcgtcgtaggtagtgtcaggaatgcccaagtgttcgctgtcaatgtccatcaacttgaggtcgtattctgaaattttgtcaccgtctattgggtagtattgaggggcaaacagtgtcaaaaataatggtggcaaacgcagatttcttgttttcttttcctcggagggggaggagttctgtctacccctgatgaaaaaaaaaacagcagttggaggtataaaaaaaaactttaccagtgctctcgaaggtcaaggagagagaatcggcagcatcgtcagccttgagggtaatgatatcgtcgtttccagcacaacgcaagaccttgctcagcgagaccaggttaactccgagggcgagcgagcgatcgcatctgaagggctcgaagccatcgtgacggaggaggagagcgaccagggcgacgtgagagttgtccatggcctgaagggcgataccattatctgagcagtcaaagttggcatctgagatcaactccttgatagcctcgaggagctacagacgtgcaggagggggggcgagaggaagttagagggatgtaaggtacagacaggcagaaaaagggagtttcccgactcgtatgtgattgtatgactcctgcacacatggctcttcgcctctgagtctgaacaataacggccgtggtctgacagtcgacgtttgtgtgcagaaagggggaagggttgttcgacgggtggtttgccgcgcgtttcaaggatgtgctctgcctggatgcgtcctgccttgatgtgtcctggggagatgaaagccctgccgtgattgcgaatctcaccttcttaaggagggcaccggtctggagtctagcttcaagcatgttgtgtgtgtggatgtgtagagggggggtggtgatctggaggtgatgaggtaaaaggcgaagagtaaaagagaaagaaaaacacgtcgcagagacacacgaaaagatttataaacaaacaccgtcgcgtacccgccacaatttcatttatcgtcgcgggctccttaaccgccttttgggtgcgtgtctatgtgcttgtgcacctcccctcctcacttgctgtccgcggagaatcagcgggtgtgtccagcgagagcgaggtatccacagtggcatccttaggagaatccgatgaagacgtgggtccagtggttgtcaccactgtggcggaaggagcgcctggtgcctgacccgctaatggctttctaaatttcccttgcagccagaccctatacatcttgaccttgcgcaggcggttcacaatcagccgccgatccaccgcattctgctcgatcgtaaacttggatccaaagagcttgacaatctcttcagagtcaaaaaagtatacgcgtgtaccatcgcctcgaacgtagaaattgtccgacaagagtcggttcttcttgaaacgcagctgtgccatatcgtaccgtccatagtcgcggaacacgatcagtccgcctggtttgagcaactactcgaggaacggagaaagaccacgtaggagagagtggaaaacattcatcagtcaactgcaggccacgatctcacagcaagcgcatccaaatgtctcaccttgtacaaattattcatggcctgctcccacttgtcagggtgaagcgcggaaaggacaaagatcaaaacaaggacatccatggactcgggctccacctctggtgggatatcatcgctcgccagatcccacacaaacgcctttcccctcgtctcgtcataagcacggttgcccttgactacactgacagctgtagaggaaaagtcgcaggcgtagacaaacagctttgggttcttgctctcaatcaacatggggaacatggtgtttcctgctccgcatccaatctccatcacattcttttcgccagcctattgatacgaaaaacgaataaagtgtgagatcgtcgttcaacatgggcacgagcatgcttccatgtcgctatgcaatgagcacgcagcttgtttcctccttacgtctgcttcaaccatttgaaagagttctgggaactctatccggagccaatgccgatccttgaagaatctgttttcattctttgcataaaacttgttccagttatctgccgcctctgcgtggtatgtctcgacaagctcctcaggcactggatccagctgttgacgcgcaatctcattcaatgcgtgctgctcctgttcctcaccccaaggagcatgatccctattaatgcggcagtaaagtgattgcaaaaatgtgagtaaatatgaactgggtcagtccaagaatgtccttttttttgtttaagctcgtggcagttgaagcttgcaggttgccgctcgctgataacgagatcttaccaggcattctgttcaaaaacgtccgactcatctgtcaggatgcggcccccaaaggcctttgtttcaggtgcattcacatcccttgagctggattgctgcttcttgtcactctcggcggtcttttcgtccttggtggttgcggtcgacttttcgtgatcggcaatagttttatcttcagcaacagcaacttttgcctccaactcctgcttcttgacgggcagtttatcctcttcagccgccaactctgaagggcgttttaacgaggcggcatctccagcaaccgtactgtgatccggtgtttcctgatgcccagtcttgtccttctcagcatcagtgttacagagtgattccttgagaacaatgtcctctgtcgtctgttgagattccatgatggttgtctctgttggatgttggtgaggatgtcagagagcaagagcgcctttttctgatgtgcatatgcccaaactttgatcttgacagtcactgccatttttttttcttttgtttgactccgtttattcgcttctcactcctggccatgtccgatgctgctggaggctatcgtctctaaaaacgccatctatcgcgggaggtatattcacttcttccaccaagttgttcaatggtgctcggcagcagcgggttcctatgtggaatgttgtaacgttcatggtcaaatccttggtcctgatagtaaaaacatcctggtatctttccagtcgatattctcaacttactgctgtaggtggggggatgttgcgctcaaacttggttccaccaggggccgtgggtgctattacgatgagtcgcatggatgtccggaggtgttagtaaagttaaaaggatagttgtaacactgtaatccagaatttgcttcgatccaggcatggagaagtttcctggatgtgtcgtagggtgagctatagatccaaacgtcctggatccgcttttgaggtctagagctagctaagaagtcaatcctgtaccctcctggtgcaccgcttgaacctttcaagttgctagctcaaagacattggtttgctgctagtgacattaccaatataaggatcgggatgtctcaattccttcaactgacgctcggcctcctggacagcctgggcgatctggcgtgggtggcgaaggttcttgtttgcgtcgaactgaatgcggagctcgacagccttgcgtctgaacaggttggtgtcaatgtaccagtcctgagcggtcttgagtgagcgcttgtacagggactggaccaagcggcggtgagcaatctgtgcctcggacatgagtgcgtgtggatgtggggatggagaaagagtggagagggaggtgggccagcaaaggtggaggagagagagagagaaggggccaggacgaaggagccgttcttcggaggaatggaatctcgtttccggatggctttgctttgccctgccattctcacaacctcaagaggtcgtctttttgctttgactctttttcatttgctgatctcccgccccttcgcccagtcagccagccagatgccttcgaccatacccgtcttgcttgcgcctacccacctcaccaagcacctcaaggtttttctagacacggcaggatggcgcgacaggaccagattgatcacccgctactcgcaaatcaatgaggagggaggcgacttggcatcgtacatggcaatggcgctcttgcctgtgggaccattcagtacccggccagcctttgaagtcaaggacatggagtccctctgggagctgcttgaaggaccagcaggcacgcactctccactggcgctgcccccagcagtcgccgatccactcactctcagatcgatattcgtggtccacctagcaccctctgccttcgcagcaccgaaacatctgctcgtccaaacaccacttgaaaagcttcagcagggcgtatccaactttctgaccccgtttctcatgacttgggggcaggagagacttgacatacaatcgagcgacagtttcctggggatcgacgacttgccacggctgctggcttccctccctcaaaaatgggagcactactcggactttacgctcttgccaccttcagccttcctgtctgcgccctggcccatggtcatgaagcgtttggtagcactggacaacgagcaagatctgaacagagacccgctcaactcggacgacaggatcctggtaaagtgggagaagctagtccaagacgcactgcagtcgagtcacattgcacggaaggccatcatccccgtgaacgacatactccgtcgacccactatccgaccactgactggagactggaaccttcacaaccggtacaaatcgtggctcgaggacgatctacatttgttggaacatcaggaagtcgaggacgacacgacgcttcaaggcaatcccccatccagtacagccgagtcactgcagccaacaaaggaccacttccggcaggcatattgggccgagacatgccagaaccatgtctggtatacgtgggcgcccatgttcaccatgttctcggcaggcaacatcacagagaaggaacgcgtagcgaaatcacgaccgattttcgacgcgaacggcaagaccgtcgtggacctgtacgccggaattggctatttcgcattggtctacctcattcatgcaggtgccaaagttgtccatgcttgcgaatggaatccctggagcgtagaaggtctggcccaaggcgctagcaggaatgagattccttggaaaaagtacctgggcatctctgaggcacccaatggggcagctactgcagcagcgacggacacagcgaggccaggatccatctcaaacgagagagcagggagtcaaggagcattgcaggcgttcgagacgagtccagaacgagctcttgtcccaggcaagaaagccaaatcgtatggcaacctgatcatttacccaggcgacaatgcacagtggatcgacgcttttgaagatcaggcgcatcacgtcaatctgggtctcattccctctgcagagcctggctgggtgctgggcgtgcgggctttgtgtcctcgcgagggtggctacctgcatgtgcaccataatattcgcgttggcgaggaagaggccttcaagacgtacttgctcgactcattgcgcgatctatttgcgctctggaagacgagctctgcgccttggtcgattcatatccggcacatggagaatgtcaagagctttgctccattagtgtttcattatgtgatcgatgtagagtgtaggccatcatccatacaggcgttgtaagatagagacccacttgatcatagagaagaaaagacttgtatattttatgtattgtacagcgtataaatgtgtgggcagaacaatggaacatggcggacgaatcgcgtcgaagaacgcaagggcaagagagactgtaaggaacattttagatcttcttcgccctcttgtttagcgggccatccagactgtggtcaaggccctccatcgacaaggatcttgaccgtgcgttgttcgacactggcgatccatccgttgaccccgagtggttggtcgaaggcgacgacgaggctggggtcagaaccggcgtcatggcggtcgtgctcatcctcaggttggacgaaccaggcggggccaggttcttgatcagagtaggatcggaggaggacgaggacgaggaagatgatgccagggtcacgttctgcccctttgcgagcggactgggttgatggacccgcgacaactcgcgctcgcgaggcacgggccacgcaaacgcagaacttggctgagcacttgtgggcgtctgaccaaagacaatagggctgagttccgcctgtgacgcgtagaactctgggtagaacgtggagggcgagggaaggttcttggcgaactgagaaggcagcgtcgaggacatgggagcagactcaagaggacgcctctgaatctagtcgtggagggtagcaggtacaaaacgtttagcctattgccatcaattctgtccagccacacaaagtttttttttttacataaaaaaaaacttacaggtgggagctcgctggactcctcggccttgatcatggagtctgtcagcgtcgcgttattctccttgttgccctccataggaatctggactcgtagcttgggcttcttgatgccattggtagggctcagaaccggcgatgttgctccggcagctgtggcgtttagtgcagaggtcgatacggctgggactggaccttgtgcggccgacgtaccagatgccatggacacgttctcagactgcagtggctccgactttacctcggatagatttcccagcatagattccgaattatcatcagacgtattgctgagaagaggctcggcttttgccatggcaaggtggcccatgagtggcgaggaggactgggaaatatcttgctgcatctggtggtgctgctgttgctgtggcgatgggtggtgctgcacttgagactgcattgtcatctgttgctgctgttgctgctgctgctgctgctgagagggcaagctcatgggagccgacatggggatctgcagattctgtccagtttgaggctggctcatggatcggttcaaaaacatggtctgtggctgctggaactgttgtggctgaaaaggcctactgtgcgcgggcatctaaacggttttgtggggaaaaagtcaagaaaatgttagcaaactgaggtctccctagttacagaattcgtaatttccgatgcaatcgccctcagtacctgctgcataggctgggaggtcatcgatatttgtggctgttgagtgtgcgacggtagctgctgaagctgttgtagttgttgatgctgctgctgctgctgttgctgctgctgttgctgcatctgcaattgatgttgttgcaattgctgttgctgctgttgttgatggtggtgttgttgctgttgaagctgctgttgctgttgttgctgctgttgctgctgaaggtacagctgctgctgttgactgtactgctgttgttgatgctgctggtgttgttgttggtgctgctgctgtctatactgctgatccatgggtgtttgctggtactggaaagcgtcatattggtgtgcaggcacagtaacattgggcatagggacctgataagggcttcgaggcagatgcgtcggcataggcggtggagtgtgcgaaaagctttggtgatggggaggcggtgtctgcagtgtggcctgaccgggcgtgtggtggtgttgatggtgtgcgagggagtgatgtggcatggactgtggctgtggcgtgacagacatcgtgctcctgttgtcatctccagcgcccgacatcatgtcttcgccttcctcgtcctcgtctttgctggcggtcgcggtcaaaaactctttgtttgtgtaggtctcgcatgaatcgttgtactagcacgccgcatggcagaaaaggatcaaaagagacaatgattagtactgagtatcaggagaggctatgcacaatcatagcgcgacaatagggggcggggataggcgcagagcagtgaggaagcgagcgaagaaaaggaagggaaaagaaaatggcataattttcaatcgaaggagtatgcgtgcacgcaggatcaatgagggtggagttgatggctggacatcatggggcgctcgaaccaggcaagcgtctcgtccgtggacccgggggaggagctgatatgaggattgacagacacaaaaagagtgggtgacttacctcagtgtatcggagaaggatctggtcaatatcgtgggaggagtactggactagcttgttgttagagttgaagatgatgaggcctatctgacagtcgcaaagcaccgacagctccatggccttcttcatcaacccaaagcggcgcttctggaacgtcacctagaagaacagagaaagaacgatgtccgttcgggaatctcgttaagacacggaattgttgcacgcaacgggcctttatccatttcggtcttggtcacctcacacaccactcgcgcgcgtagagccccgtagcacataacacacagcagcctggcacaaaaattgcgcggtgtgttcagcgaaagtgaacaagcacagagacagcggtgaagtaaaacttcaggtcgggaggaggcatggcaatgccacgatggtgtcgatcctgctcgtaggccagggcgagttgctggaccctgagctcaagattctattctcaacctcattccttctttttttcgttcgctatttttacaaacaagcgtggggtgtcgaaaaatagaaaaaggcaagagtagagaaagaaaaaaagcgttgacggtgaacaagaccaagatataaaaagaatagatccgaaggatgcatctcttctcctcaatcatctcatcagcacttgctccctgcctcagcgacaggcccccatcacctctcttcaccttggcgggacgccttctcttcccaggcgcccccgataccgctctctttgctcactttaagaaaaacaagttgattgagaaatggtacctggcggttacgctcgtccatgatggtcttgatttgaatctttttgcgtcccatgatgcaaatgtggtaatgtggtagtggaataagaggttggagtgatgctggagggtgccctggtgtatgtcgggcgcctggtaagtgaggagaggtcacagcaactgagaatgaggcgattcacgagcgggtgactggcgtgcgcgttataaaagctgcaatgcgctacgagtcttgtgcgagagtgggaatgtacaaggttgaaatccaagggttgcaagcggaggcgtctggatgagaagcgatgcgatggaaggcgaaacagttggcggctgactttgtctgcttatcgcacgaagaaggaaaaaaaaaaaaaaaaaaaaaaaaaaaaaaaacaataaaatataaaatccaggcaggaatttcccaaacttgtactttgaaggaccgagttctaaaaggaagctagacaggcaaggcaaacggcaagaatgacaaacttgtagaaagctgtagagttgcgagtatgggcgatagtaaggagagaagcgaggcatgtagagtgaatcctcgtccgtgttccttggtacctttgcacaccttatgcgtgtgtcgtacacctcgctttcgtttttctcgcgctaacaaaaaggctgcgcacgtgatgttccccgagtatttttagatgagagcagttttgtatttatggcccgccatatatacctcgccgattgtattttgggatgggagaaaaaagtgagcgctggatgtgagaagcgcatcagtaagattcgcgttgagtggagaaaccctcatactgtattttgcttcatggcggttgaggcggccctgtgcccgcaaaatgcggcgcccctatttgccaataattatcgggtagcgtcctcgccctacgcccaccacagcagacaaacggccacaaggcgagacacagcaccgcagagagatacataagtagaacctcattctgtccccatatcgccctgcatccgtccaccgcggactacactgcatctatattgctgtacatgcctgcaggttagcctgcgacccgaacgataggatagagagaaagtacctacaagagcggggagagagccggtttgaacctgaatttgcgggttcttcaagtcgtttacatttccgagggcaatactgaaactgcactcataagtccgtctgcgcgagtgcatctcattaatcaaggggagatcccgtcctcagttcttcacactccacggtcgacagactccctatgtccccttttttgttgtgcgaacatagtctaccagcttagttttcatacccgtcaaggatcgtttacagcaatgcaactccgccctaaacgtccatagtgcaagcgtatatcgaaatggtacgtggttctttatctgcagtgcgcacttgtttacgtgtaactagtgactacgattgaaggcgcatgtcttggtccggtgcttgtattcatccaccttttccaatagtcgttccgccttgtcaataagtcccttgcgttgtttccggacagagttatcgcctccactctccactgcatcgattcgaagcatggctttggttagattctcctccgtctgcaggatatgtttcttattggtgatttcgccgctcaaaatcttgtgtagttcctgcgaaagctcttgtagatttcgttcaatctcatgaagctccaccagactcttttgctgctgctccggatcgggctggatggattcttcctcgtccgtgggatactcttcggttgcgctattgtcttggtcactgccgatgtggtccgaagcttcgtccgagtcaacctcattctctaacgccgaggcaactttaggtttaggagctagcccacggctgtccgataaggtagtcttttccccgaatgcggcctctaccagtgactgcatgtcgtctacggattcttgggatgcggaggttgctgttgcttctccaccggatcgcgagtcttgtcgatcgcgccttcgttgtcgacggtttcgtgcactggaatatgcttctgacctgccagccggtttctgctgctgctgctgttgcgattgctgctgttgttgagtgcgactaggacgatggctttgctttgctaggggagtgtcgtgcgtcgtatgaggtgcccttccgtgagccgctgcatggtgttgctgctgttttcgttgttttgtaacttgccgtagtctttcgcttttctcctcatcttcctcatcttcctcctcgtcgtcttctttgtcgtgatcgtcgtcttgtcgttgctgctgctcccaaaaggcgcgctgccgttgctgctcctcttgcctcgagtgttgctgccggtggtgctgtggccactggcgctgtggcttcagacggtggtgtgaataaagctcaggatcgtccatgtcacagtctctctgacttgttggacgaccctgctcagaaaaaggatcaaagaagagcgagtttgagaaggaagggaagaagtctgttcggtcctggcgacgccgcggacgttgagtgtcccggggctcaccaaggaatgaatacatagtgcagcgtggcgaggatggctggatatacgagagtgcgagagaaaagtgtgggtgtcaaaaagcaggtctgctaaaagaagtttttttttctttgtgacacgggagatttataggcatagcgaagatccgccaatgacatcgctggaaggtgctcgaacaccctgggtcacacccaatgacactggaaaaaatagtcagcacactaacgcgtatcgcaccatttgtctaaatgcctaggttagatagaacctgcaatagaagcattgtcacactgactctcatagtgatacttcttgctgctgtcgccgttgccatcctgagctttctcgatcaggtgtttgtgccagcccatggcgataagtacgaacgccttccccttggtagttggtagcgaaatgttcccacaaggcgtggtagttacaggtgtggtcaaacgggcagcaggaatcgatccttccccgctggcgtcttgatttcttggacaccaatgatattaatgcgctgttctcctcccatctcacataataaagcaaaaaaatcacccacacatgttgatggaggcggccgaaagaagatgagggcaaggatatgcttctgacactgtgtagatggagcaaaagcaagagatggcgctttcctcccaagctcgctgcgatttgttctcgacgcgagctagagatcagtggttccatataattttccagaccctaacgtcaacctcgctcttcctgactacgctccgtcgttctctctcttctacgcctctgtcctcaccgcacctgtcgactacactctgtcgttctatcttttctgcgcctctgtccgcatcgcacctgtcgactacgctctgtcgttctctctcttcagcgcctttacccgcaccgcacctgtcgactacgctctgtcgttctctctcctctacgcctctgtccgcatcgcacctgtcgacaacgctctgtcgttctctctcttctacgcctctgtccgcatcgcacctgtcgactacgctcggtcgttctatcttttctgcgcctctgtccgcaccgcacctgtcgacaacgctctgtcgttctctctcctctacgcctctgtccgcatcgcacctgtcgactacgctctttcgttctctctcttctacgcctctgtccgcatcgcacctgtcgactacgctctttcgttctctctcttctacgcctctgtccgcatcgcacttgccgacaacgctctgtcattctctcctcctcagcgcctctgtccgcatcgcacctgtcgactacgctcggtcgttcgctcctcttcagcgcctcctctcctctgccaaccgccaatatgggaataaccgggctatggcagaaattgaagacaaatggactcgacccacagccgactttgccttcggatcttgcggacgtattctatgagattgatctccagggatgctttttctccgtcatcaagaccatgtttaaccaatggaaggcaggtggtctccctgagtcctcgtacccgacatctggtctggccagtttcggctgtcataagaactggtgctgggcctattgctacaatggcctcccgggcaattcgtggtgctacacgacaaggggggcctcccaagaccgtggatatgtgggatgcaactcggacaatgactgtgacccgaactggaggtgtgctggcccgtgctcagtctaattcgtggtggtctgtctaccgtggtgtgttgggtatgagtgtcaccgttatgaagaacagggtccgaagatcaaaatacgaacggtttagaccagtgtaccttccatagggccaccgtgcccccgttaaataaataaaaaaaaagatgacacgatattcaatagctctttttacccgtccgctgttctttcaactgacaaataccttcgaggccgataatcgggtgcatctacttgtccagaatcctgacatctatgcagggaccaccatccaaccagttctctttgaacaggagacgataaaccgtggaggtgatgattggtgcgaaatgacatagaaccacaatctttgcctcgtatgcagtaaacgaaagttatttagaaaagtacaaagtggcagcagcagcagctatgcctgatggcaattaagactttcagcttgttcactcagcacgtcgaagaacaccggttttttgggaatctgacctcgctattgatcggcttttgtgagcagagagtgggacaggtcaagggagatccaatcgctgatacggcaataccggagcgatgggagaatgccttctttttgctcttgtggggattacgtagcttggagatgttggataccaagacgtattcgatcgtgggcgtagataatgtgacggactttgagtttctgcggacgcgaacaaaaatactgattctgaattggatagggatttggcagggaacttttggcagggaacttttggcctcattagcactttcttcatgtccgatatgagagtgcacaagtcgcgaacaattttttttgatgtggttgcgggcattgtgtgaatacggcctggcgtcgagtctgttatcaagcgtcactacacatgagatatatttttgtatttggtagtattcagataaacacaatcatggatgtgctatcgcgttgcttgatacagtatgcgtttgcttaaggaatgcttaattagccacatagaccattgtcataaacaagatgagctatgatctggcggcctgtgcgagggagcaaaccgcatacggtctacattcttatcgtttcgttactcatgatccttatttggtcgcgaatgatttgtttactcacggcatcgcatgctttgctcaccttgattcctacgcctctttctttattcatgcgctgtgcagatgtctttctgcgctaacacgttgactgactattagtctatcctatgttcgctttttcatgcgatacgcgagttcttctgtcatgatctgcacccttttacaatccttgattctttttcctgctcgtgaagtatacccacggtcctctccactgcatgctctaacttcccatattctttgtcttcattcatgcaccgtgcatatagttttttgtctactttccacttggattatctgcgatcgcgcgttgatacatccttgcactcattttcgattattcatgccatgtggactactccttcctgtggtgatgtacaccatgtaacaattcctgcttgttcttcgtagagtttacccacggccttctctatttctctcgcggctgtacacgctctagcttcccgtgcaagctctagcgccccacgccccttttgtttatatactagacgcgcattcgctcgttctcctctgccaatggcctagatctcagatggtctattcaggaccatgcgcaacacatgaatgatctgtcttaaacatctcggtcgaatataaatgcacggatacatggttccgtccaaacgcatctccaaccacaaccccacactcttttcctgtacatacctttcacctccaaccaaagcagtatgtgttttttttttggtcctcgttttccctccatcgtcctggtgacgcaacaatgttacttactaaaaccttttgttcttcgcatcataatctgtagatttgaaactatatctctcttgtttcatcatgaaggcttttacttcgatcgttgctgtcttcttgaccttggccccctggatgtcagttggtctgcccaggtccccgtgcacgacggatgacctctccgagtcccaatggacggcgggaaatctccacgagtcccaatggaaggcaggtggtctccctgagtcctcgtacccgacatctggtctggccagtttcggctgtcataagaactggtgctggacctattgcaacaaagagctcccgtacgatttgtggtgctacacggcaaaagggcccacagacagttatgtgagatgcaactcggaagatgactgtatgccgaactggaggtgtgctggcccgtgctcaatctaattcgtggtggtctgtcgaacgtggtgtgttgggtatgagtgtcaccgttatgaaggacaagatccgaagcgctgtatgcgaactgtgtagaccaggatgacaatgcatggggtccactgtgcattcttcgtttaataaaaaaaagccatatctaagcagtttatcacagtccgttgacgtgacgatcggtctggaaggggttcagggggacccaggctagcacatgttgcagtctgcacatacataccccggccattttaacgtatacagtcctgtcccggtcgtttgcaaattttgcaaacgaccgggacaagactgtactacttgtgtccgtgattcaaaataatctctcgttttattacgtctcttactggccccacaatttccgctttgatggcgtcaggtgtggaacgtgtggaaggcgctttgtctccatgcaatgtatttccaaccttcagaattgctgtaaacagcccttcagctcctcccaatgatgcttctgtggaggatggcatgctcctatcatcacagctgctgtgcgactggacacgacgggcgttcgaagctgactcttatcaccttccattcccgtctcggcaagaagtcaggagcgctcgacacatcaccagacacgctattgggaggcggtacaaccttaagcgcggcagtgaagcatgatggttccgccggtaatgagtcgacaatggatttgcgtctatacgacattgcgacaggcagccgcaaggacaggtcatccctgaggagttttgatgcgcagcgggaggacaacgggcagcctaggccggtcattcagggcgaggcgataaacggaaagcgcggcattgaggccccgatcgagaagaatttgcaatatcgcgatccatcgctgcagaagcatgacgctcctcgggattgcaggcaatcattagcattgtccgaagcggggccttcacacatatcactggagagagcgcgacaggtgcaggagtttttgtcgttgaagcgacggcatcggacggtatttgtcttcttgagcgggtgcagagtgctcatcgagttaagtctaaatcgtcgcgtagcctgcaacagctacagtttttcatgcggcagcttcaagggctggaggtacaactacgacagctcctgcagtactactctgactgctgttactgcaagtcaccgacgaccccgagcatctcgcctcaagggagccactcgagtggaggagcggctgcgatcacggacgatattcgccgagagagcgatatgctggtgctttggcagaacttgaagtactcgctggaaatgatcatcttgcaagtggagcgctactgctcacaggtgaacgtttctcatatgacaagcgcatcgtagtaaacaacacattttcatatttcgccggtctttctttcctctaacctcactgtccatagaagcacgttttgttatatatttcgtaaccttgttcctggctgccaagagatccgtttgcatcatcccatgatactttatacatcctccatcccattgaatatagcattgatcgcctgtagattctcgactctctgggtgttgtgctgtgtttttgtcacgtctcaatcgtattcatagttgtggtcctgggatctgcgttgctgttcctcgatgatgctttgccgagcctcagcaatttgttgctggaccatgcgtctcttctcagcgtattgttactgatggatgcgtatctgcccgccgtattgttcctcgagcatgcgtctctgctccgcggcctttggcctcagcggggcgatccgttcgtcgcagatgcgcctttgctcctccatcagttgtctcttcctgacgagctcttccgcgaccctttgcctcggtcccgcatacagttcctcgaccatgcgcttccgctcggccatctgctttctgatcttgctcttggcctcgatatactggtcggagtaattctgcaagggatccatgtcaatgttagctttactcactcacgtaggtggcagtggttgttggtgaaacatgtcctggcagccattcgaggaccattcagcgttatttgatttccgtgctatgtcaattctttatctaaccagtgaccacacaacatctcgcaaatcggggactgctgcctgagcttgggcgcccttgcttcctggacgggaaagtgctgcaagagaatgatacagcattcatcggcaaaagaggacaagggtcctatattagtcagtgagtgtacgagtcgatttcgctttactctaaaagaggcaggaacaagtgatctgtctggaagcaatggtccaccaagacttgacccggaacctcacgcgccaggtagtgtggagggatggaagtcgatactctcctctctgtcgaattaggggcaagatcgagggcttgcagcgcgagacccacgcgcgtcgtggggctctttagcagcatggatttgatgaagttgacacgaactcgttcttgacgggaagataccgatagagacggctgagccacatgctcgtatgaacgagatgattgttgggggagcactctcgtcgtggaggcgattgcttaatcgatggttgagacgagggctggtatggggttgtgatagtgccaggtacagccatgacgcgtagaaaaacgtggggtagggacagccaagagccgccctcagcggcatggaatgtgccattcatatcgatacacctcaaacagtaccgcgtcggctgacagagggaggatttttttattttaattctcaatgtcatcttccagagggcgccttgatagcatctcgacaatatcctaacagcaagcccttggcttgatggacaatcttgaaagtagtgtcgaaagtcgcatgaggacctaggtgtttttaccgtagttgggggcggtgatcccgccgtggccggcaacaaagtctttggcgagcccgaccgggtctgctacacgaacacgggcggttgggttggtaatggcgtagagttggtagtggcagtagggttggtagtactggttgagtcgcggtctgcctgacttggggtagtgaccgatgcaacggactctgtgatatcaacgggagtagacgtgacacaggttgaggaactggggaaggtggaaggagcagcaacgtgaatatcctggagcaatgacctctggcagagagaggagtgcgaaattcgctctcattggctgactgacacgtcacagtctcgcgctctctgatcaggtccatcccatcatcagcatcctctcctgcctgcgctcggttgcatccacatccttctcctttccctcgtttcgtcggaccaaccctttgctgctggatacacgccaagcgacacaccacaccagcggttatcctaaaagaaagaacgaacaaaagaccagacaggaaagcatcccttccccaatgacacggaagttcttctcggccaccgtggccatctccatgctggtccttgccacgacctggctccagccagccagtgcgatcaagttcgagctggccggccaggaggcgagcatcgccactccccagtgcatctctcactatgtcgacgacgagacccaggtcgtgatcaagactaaggtcggcagtggacctcatcaaaaagtgtccgtcgaggtaacatacacagaagaggcgcgcttcgagatctagcatacatcacaacagccggtggaggtttattcttgcatgacctgacccttgcagaacaaggaccctccagagtccattcacacaaactgacactgaaaccccctcctccatctgtttttttttgtttgcccctgtggaccgtctcgaactaggtgacagacgatagcgagcatatgaatcagctttggaagaaggacaacctggccgaggacatgcagcgcggtgctttcgagacgaagcgtgctggagatgttatcgcttgcttcacaaacgcactcaccgatggtaaagtatccatcgctcttgagcctcttctgcttctcgccagtgaaagttgagcttacgagggacaggaagcttatatattcacacacatgaatctctatttcacttccaccatccatttagggtacaagcctgatcctagatacgtgcgtgttgtggacattgactttgagattggatcagagacttttgactatgccaagatcgcagaggccgaaaagttgaagcctttggaggtggagcttcgcaagttggaggatatggtcaaggacattttggaggacatggagcaccttcaagcacgtgaggagaggatgcgtaataccaatggtacgtagaagctattcgacgcacacacaacacatactcgctcgatgcgtgtgtgcgtatgtgagagtctgtctcgtccatcctcattatgcacgtctgaatcctcagggacgcatgacgcagaaacggacctcgcctctaactcaaaaatcactcgttttgttttctgtctctcaccctatggtatcttagaatcgacgaatgcgcgtgtgcaatggttttcgaccttgaccatgtgtgtcctgatcgcattaggactgtggcagatcttttacctgaagcgctttttccgcaagaagagactgatcgactaagaaatcagaaagcaggaacaaaaaagaggtggttcaaattccaagaattcggcgtttctttttttttttttttttggcttttcttacctggctgttgatcaggcaagcaggactttcaagtgaaaaggaaaagcaaaaggggagggaaggaaacgcgagagatgaagaagagagagagagagggagagagtagttgagcctaattcgtcatttttaagcataaactcacgcgagaactacgttcttgaaatatgacttggatcgataacggtggcatggatgctagaatgggctgcgaaagcgtcatatttcccgggaccacccgctcaactcaccaagactcgtaacgtcattttctttcctctgcagcgattgaatactccaccatttcttttttttttccatctctggctgtttgcaggaacgcgatacatccgaaagtagtactgacagcatatttgtgttcaagtggataagcgaaaaaaaaagaaaaaaaaacgccgcttcagggcagcaaggatcaggagttgtctcagtgcaatagaagaagagaaaaggagatggcggccgaacggtcaacagttaagaaactcagacagtcctatcaaaatcaagttcgtatcgatgagcttcacttcccagcaggatggacactgaccatggcccataagcctagagtgataaaatgtttttctttctgagccgtgtcaaatttcatttatcgcagcagcctccatcaaagtttttctggggggcgaaagtacagaacggccacaagcaggccatgagacggggaggtgcctcgtcgagacatggaacgacactgtgtgcttgagctgtcagccagactctgcagctgttcgtttattgagatcgagacaatgcagtcgaaaatgaaggggacctgatcagcaaacacccgaaacttttcttactgtccaactgcttaacatgacttgattgcctcatcgtcctcgatattattgtgcgttttattttcttcactcatccaaatccctatactcatcgtaaagcactacaaaaaacaagcacgcggcttcatccaaactgggaagccgcagttgcgcacaatgggtgattcttgtgtaggcaagagctgaacgagtgagtgagcaaagagaccgcatgtcgtttcagagcgtcttaagaccttttttttttttttgcgttcatactttgtccatgagttggtcttggtggctgtagtgacctgggtataaagttcccggttgtaaaacaatctgacgtgatgggtgttccctgtcgtcatcgctgtgaatcaggacgcgcaccagaacgagtgcgcgtttctggtttcaatgcattcctcattgatcaagaatgaacgcgataaggcgcacaaaaaaaaaaaaggaaacgacgcgagaggaaagtccaccaagatgtcgtcgggcacttcatcgattaattcaccgatatcaaaatgaacacggtaaggcatctcgtgagccgagtcgtttttcgatggacgttttttcccagagcacctcgtaatactgatggcatttgtctttgtgcgacgttggcgcaattgtgaaaatgaatgaggagtgttgccgcgggatcagaatggggggcggttaaaatcgacgtcatctcattcacagcaagagcgagtgctcacaacgaaaaggaaaaaaaaaaaaaactgttcgtggaaaatctaaaaacgttgatcacgaactttattttccagcttttgtgctgaatgcaggtacagttccattctttgccacagcttgattgtgtttacgatgcgaaaagaaaaaaaaatactagagtgacaaggccagttaggatccaagaggatgagaactcacatgaaaaggaaatgtcttctatatctcgtgtcagtcatatttctttttttcttaacgaatgaacgcgcaaaaaaaaaaaccagctagtgccgagatgaactgtgcacagggccgcgcaaacaggcacgcgcgcgcgaggtccgggtatgacacgcacacatgctgcgacactctgtgcacagtgcgaaataaacagctgctgccgataaagagtctgatctctcacctctggttcaaacgtccccttgatggacgatgcctatcgccgcgtggaactgatgtagcagggctttaggagcgggaagcaattgctccaataatggtgagcggtgtgggtatgaaatttcacccgtcgctcagccaggaaaagaaaaaaaaaaaaaaaaggctgatcgtcgggaaaaagacacatggtttaaattgaaccatgttcagtgcatgtattgccattgtttttgttgatctggctctctaaagcccctcctcatccagtccaatcgccatgggtcctcaccatgccatgcagacggcagcctccatgcgcgcggtaaaatgtctgtgaaagtttcttcgtatacgccacctgccacattcagaatttgagacacaaaaaagtaacataccttatatcgtggtctgtagctgaatagaggatgagagcgcgatatagtaggtaaagagcttcaaaaaataaggagctcattgatgatcaaggctgaacaaaagatgagatccaacggagggttttgtatggctcccaggggctttcaatcttggaacagaaaaaaataaaaaatggagttgaggaaaaaaggagcattttctgagcgggccctatagctgaggttcaagccgcagagtgaatgcaataacaccagtcaatgttgtctgctctgtaagtgagtaaagagaaaaagactggtccatagcctaacgccagatggtgaaatgagatacagcgcagagcgtgcttattcaagttttcgcttcctcttgttttttttattttttattttttttatttttttcgttgacttgactccaagcatgcatggatttgaagttcagaccgatgaatgagtcgcattgtgaaaagatggggatacgagctgggcgtgttcgtactttcggctcgatgctgtatgcacgctcactctctaattcctgaaatgctcatagtctattaccgcactgagatacgacgacaagtttcatcgattcttttgctgtttgttttcttttctgtcctgaacaggtatccggcaacgaactgtgccacctcgtttgcggaatggacatcaaagataacgagggtccagaggaggatttttgttgcagtgtcgaaatgcagaggaaggatgttccaagtttgcgcgagacctaaagtgtcttgacgcgtgtctttatgctgtctcggcttggcggcggagtccgacgaaaccatcaagcgtgccagttgaattccgatggctttgacctggttttatagcgcatcggctgcgatccctgatccaggaggtagcaaacaatctgatagcgttattggctgttcgtttaacgtggcagagtataaaaaaaacaaaaaaaaaaggacaaagggtcttagcctctctgcgacagtttagtggtaaagaccggcaaagagcgatccaaggtgcagcatgcatgcgtcagacaaaactcgcagctgtttcaaacagcggaaaggggagaggggatcctgaaaacaggcgggaacaaaaccgccattggaggacagccacacacacagattggaaacagcatgcacgggaaagagctatcatatcatgtccactgtcttcctccatcccctttccaatattttggaggagatatactgtattgctgtacgtcgttggtacctgatggttgaatagcaggggggggggggggggggaacaagggcagaaccaataggaccatgaagattgaacataaccgagctactcaagacgtcggccaaaagtttaagacgcctcgattcacgtcaagtacatttgtggatagtgtactgccggagctaatgccttcagccatcaacgacaccattctcatccaggctgttctatgggtttttaattaacaatgtgtgtggtcatctggtggtctttgttttctcggccttgacactttcttcaaattcttactctcatgttcaaacaattttttttattattcgagctctcgttgttgttgggtcgttcctgctcagttcgcgcgaaggtgttattcagtaacacaatgagcacccagcacacctgagcatagaagcgtggaaagcagccaagacagattttttgccgagcttttcctaagcggattaaacacgagttaggagagggggggggggggatgatctgtgatgtcgaaagggggtgggggtggtgaggaggagtattggttcgaagtactctgattgacccaccatagagatccgagatgaggcttgccatgcggcagtaaagaaataaatacaatgcaaactcgcaagccgacgactatcaaaagggcaagaaaaaaaaaaaaaaacaaggaatcttcgcggcggcatgatcgcgctagaaccaccgattctggcaaggaacgaatgtctgacctggcagtctctggtcaaccggctttcttttcttttttctatgcctcgcatcatggctaaatcagacaggcttggtctcggaagccagtttgaggatcgggggtggatagcaacgcgtgtgggtgagctcgcacgggtgtgggatagacacacggatgggtggacgcgcacccttacgaggcaggagtacgtttgtctttgcgaaagagtattggaatatggatgtgcagttgtgacactcgagcagttggcctcatcccgcgcctataaagaggatggtcgcggagtggttgcaagggctattgtctcttttttcttgcccttttgatcacacaaagcggttcgtccctccatccacacggtgtttgaagctgttatctctcgagcagtattccagtctcttttatttcctctgtcctctgtcctcttgttctcctttttttttattttctctcgctctctcttttcctctcgcactcgcacgctcaactctcttttctctctcttccactcttttcactctctctgcagccctcttccagtccccgctgctcatttctcatttcgtccttattacctcactcgctgcagcaccatcgcacacctctcatcacccgccgctccatccggtggactcgcttcattggtaacgaacagcgcactcagtatccaaccacccctcctcattgtcctatctcaaacctgtgcctgtgcctgtgcctgtgcctgtgtgcctgactagaagaactacgcacccgctagccctgtagaaaacggagtgtccagtactagctccatttgcagcctgcaacccatcgtcaacacacacacacacacacacatacactcccttccacgcagcgcacacgcatacacacacacacacatatatatttgtacatacatacacgcatctctctaccgggtcgtgttctttgcttcctcctaccttctcttccgttcctcctactcttctcagcctgttgctgagtccttgtcatccgacttgtttccttctttgccacgaaccatgggaacactcagtgcagcatgggcgttgggatgacttgcgtgcaacaaggcagcgacgccttgcgtacacactgcaaccaaaagaaggtgtcggaaacagggtccagcaaacagaacacgctacgcagaaacaaagacatactaccgctctcacgctgtccttgcactagcaccaaatgactgttcgacagccaacggatttccttctgggtccttcgtcgatctccagaatgcttcctcttcctcttgactttttttttcttactttgacgctgagagtcagtccaacctatttattattttctttaaagtgtgcctgtggacgtgtctcctccccctacttctctggaacacctccatactttctatcgttcgttccctctctcagcctctccacgaggatatactttcaggatgtagacagagtcaacaatacaccacacgatgagagaggggggaggcgttccgatgagtaaacagcaaaagtgctttgttgctgctcgacaagtgttcattcttgttcagcctgctgtcgtcatatgtccgtggcgtaagcaatagtcgggcagtgacttgtgcgctcgtgggagaccgtatgagtccgcttggatcaaacgccgatacagcgtgttcgtagatggcagcgacaacaaaagcatgaggaaaagtggggatatcaccacgcttgggcggtttgccatcatgagcgggcgtgtatatattcaggcaccggctgtgtatctattcttggctaccacattctcgtttctttctcactttctttctctttttttttgccctctcgtgtcttcaccacggcactgcattgaacaggcagcctggacagccacacacgccgagcacttattgccacaactaacccttgtaattctctcgtggattttggcctttctatagagggcaagcggctttttttttcatctttcgacactcgggcttcttcttgttcagccaactaccaagcgcggaggcagttctcagcagagcgagggtgaaccccagaccccagacgccagagaatcatagagcctgcatccagaaggatcgatataacggaaccgtgtaagaaagtccctggtaaggcacagcaatcccgtgaccgagttgcgccgcattggccccactcttttcccctccgtcccttgtttctgctgttctcattctttatttcaaacgcggcatgggcatgcgattatattatcggacgcggaggcaaaaaaagaggggtgagtttgacatggcagtaaaggcaaaaggagctactctttgtcgcgctctctccctctctcttctctctcttctctctctttctttcggtgtctgtctatcgttctctcttctctctctgcatgcacgtcttttgcttggtgggcctcctctgatgcacgctctacttctctctgcgacgcgaatccctctttgagtgtttttttcccccactgtttgaagtatcttgtccttgctgtgagctcctgaaattccaaggcattggccaaagatggagacgtcgctgtttctgatttgagtgggtggcgaaagcttgcccctgcgggttttgttaggcagaagtagggagaatactccgttttagagggaaaaacgagcgataaaggaaagtgcgtgttggcaaagtggatgagacacacggcgatcacacttctactcactccggcccccttttgtaactgtgcgcactcacagacacagacacacacacacgcacacacacagacacacacatacatacacacacaacacacgcaatataaacaacacactactctacccacttgtagactgttttgcttgactccaaccacatctcgcctttgcacgattttcttcccttttcccttctccaaagggcgcaaaagattcaaacgcgaggcatttttttctttccgccttaattcgcttgtgtaaagtgtgtctggtcatcacccggttttgtgtcgcacacgattatttagcatttcaaatgcgctggcgggtctatctctttgtgtgccctgccgctcgttgccctagttggttctccgaaacccttgcttacatcccgaagacaggttttcttttgtcctagtcctgaacgtgtttcttttttattttatggtttttctgtatttctattttgcgggagtgagcgagtgaacggatcatgctgctggcagcatttgtgtgtgtttatgcagtttttttttctgtctctcttcttcctctttctttttttgttgatcgcagtgccaagcagcggtgggtgtgtatccgatcgcttattatctcatcgcctttgacaaggccaacgcggaccaagaggatggacagcgagcagcggccgcacacctcacttttcataaatggtttctcattctcttcctgacacggaccaaggaaccaatcccagtgcgcgcagccccttactttttttgtgtctctttctgccctctgccgctatttctggcccacgcaaaaaacgataacacacacgcgtgctgccttttttttcttctcactctctctcactctctctttctcttctccattcacctttcttcactttttctcacttccgtccttttctcttctttcacttggcgtgcgacttgcgacctgctcctcctgtcctcaattcatccctgtatttacttttagcaccgctaactcgcttgcttggcctcgattgtagttttatcagccgcgtgtgttcagcaggcttgcaagtaatcgcgctgctccatatccaccatgagcgaccctcttactcttgcctcaggctatccttcggcccctaatgaccacaccctacatggaaacggcagcaaggacaatgcgcacgtcgttctcctcaacacagccctcaacaaccacccaagtcttccgcaggagggctttgttgtacctttgaacgaaaatcatgaccaccaccagcaactacaaatgcatcagcaacaacagcaacaactacaacaacaacaacaacaacaacaacaacaacaacaacaacagcaacagcaacagcagcaacagcaacaacaacaacaacaacaacaacaacaacaacaacaacaactccagcaacaacagcatcagcatcaacagcagattaccaacaatcaacctatcgtaatgaaccctgacgcccttcaaaccaccacgcacattattggaccaaatggtcagattctcaatacctcttacgccatggagggcgtcgtgctctccagcacagccgcacatcccagctcgcactttgtggccgtgccaaccactcagcaacaggagcagcagcagcagcaacaacagcagcagcaacagcatgcggtggctcttcagcatgcaattcagcagcagcagatgatacagcatcatcaggcacagcagcagcagatacaccagcaaatgcagcagcattttgaacatcagcagcagcagcttcaccaccatcagcatcaacagcagcagcaattgcagcagatgatagatcagcctcttatctctatgcagcaaacctcaggaatgtctgcgcaagactttcaggttagccctcagcagcagcaccaacagcagattctttcctcgctcccgatgagcccgccaacgactcagcagcaacagcagcaacagcagcaacagcaacagcagcagcaagcattgctcgtcagtccacccatgatgccggctgagccgcagccgatgccgatgatgccacaaatgaccttccagcaagtgatcacagcccacacggcgcaccagatgcagaaacaaatggattcagagcacatgcaccagcagcggcaactcaatcagcaccagcatgagcagcagttccaactccatcagcaacaacagcacgtccagcaaatgattgccaatagcatgccaggcccagttcaaatgcaggtaccagtgcccgtgtcagtgcaggtgcccgtgccagtatcagagatggccatgcatcaaaacgccttgctgatgcaggagcaaatcaacgctcagtcgcggtcgcaaacgcctgttataccctcgcaacaacaggcaaatcaagctcggggacttcatcgccatcagccttcttttgacggtcctttgagcatgattgcactcaatgcgcagatgcaacaacaacaacaacaacaacaacaacaacagcagcagcagcaacaacaacaacaacaacaacagcagcagcagcagcagcagcagcagcaggatatgatgactgctgccgcccttgcgtcgtcgcaacagggagttgtgagtccggtcgagggcaccatgggtcctatgatgatgagtatgggccaaagcctgatgacaatttcagccccacaaatcatggataatgtagtcaaggagatggatgcgatggctccttcgggaattctaagccgggacaaccaaggtcccctcctgcagaccaacattcctcagcagaagggtcttgacatggagtcacccaactactctattcaacagttccctcaacccacagcgacgagtgctcctgtcaatatggcctacccgacccctttgccttcaacagaatcgatggcgtccttcacgccaatggtaccgtcgatgcagccggctgcatcacaccctcccagtaacaattcttcgccagcgttcacacccccagaggcaaccctgacgacgattgtggatccttcaaagcgtcatcgtcgtcatccgtcttccggtcatcattctcccgagctgaggatcatgctccagaagcaggattttcagcaacagcaacagcagatgatggcggctaaagcagccaggctcgagaccatgcaggtgatggaatctcaccagaaccggtccccacgggcaccagcggcggctgggctaaagatcaatgtgtcagatattcaggcacgggccatgcccctctctgcgctcggatcgccatcggaatccgggcacgtgtactctcccggaccactctcagctccgtctcctcttctgggaccgatgaacaattcgcttgtggacaccatcatggaggtctcttcgacgttccagctgcataatctgaacgacagctccttgaactctgcgaacatcaaggaagagtcattggatccaccctcgacgcatgcagagctggctgagctgtcaaagcaagagttgatcgagaaggtgatgcagtacgagcgtcagatggaaggatctctacccctgcggaggatgagcactgtcaagcaggattctgagggcgatgcgccagatgaaatgcaacgtgagtgtccctattttaagctgtgatgctatgaaaaacgaccatattcgcccttctaatgtcttgcccacgtgcgtatgttattgttaatttagtccccggtcagtcaaacaccgcggcgcaagaggtgcaagtcaagcaggaaaagagcccacaactttcgacgctttcatcgctgcccccgataccctcgcctccaccagtccatcagcacgtgtctgtgtccgacgaaggcgttaaggaggagaaaaagttgacgtctccgtcgttggcgccctatgcagtcaaatcgcccaccaacctgcattctgttcttgcttcggctcagaatgatgatgacgaggatggcgaggatgacgaagaggaggatgagctggatgacgacgagaacgaaggcgaggatggcgaggcgtcacccacgaaatcgcgcaaaggatcgacagacgccaccacggcagatgacgcggaggcgccacgacagctggtctgtcaatggcgagactgcaacacgccgtttgaaacgatggaggagctgaacgagcacgttgcagacacgcacatcggcagtgggaaggctagctatagctgtgattggcaaggatgtccacggatgatgaagcccttcacgaaaaggcacaagatgtacaaccacctgcggacccacacgggtgagcgacccttccggtgcctcgttcaaggtaagaacactggcgtgagaggctcattgtgcagatcattttttgtatgcgcacatgttgttcagttgtagctatgacccaacactaactcattgttgacttttttttctaccttctttctttgctcgtctcaggctgcgacaaaaagttttccaggccagattccttgacaactcatacaaagacgcattcaaacgttcggccttatgtctgtactgtggagggctgcaccaaggcgtactatcatgcgcggtccctcaagaaacacgagctcgcacacgagaacaagcctggtcatcagggggctctacgcggttcgggggcgtccaaccatgaaaagtctaacggttccggaccaggtgcgaactcaagccctcagcagaaccattctcattacaaccatccctatcatcgcgatcttgccggtggatctgttcgatccaagcacagacgtcaacttagtcagggtggatccttagcagcaacagcagtggtcccagctgctgctggtttcgttgtccatgcacaagcacaagcgcaggcacaggctcaagcacaggctcaagcacaggcacaggcacaagcacaagcacaggcacagaccagcgcggtgaccgcagtgatgagctccacgtccttggtgtcgagcacgcctgccccccccatgtcgctcacaatgcacggagggagtgcaggcgctccttttggacaggccatgtcgggattcagcaaccctctgctgacgccagcgctatcgacccactcatcgtcgtcgtccgtgcctacactctctatggttatgagcagtgctcccatgtcagggacagagggtggcgtcgggctgatggactcaatgttccaggcgcagaatcaaggacacgccaacgtgctgtcgggcgaaggcaatatcaatcctcacccgtcgccctctggatctcccggatttcaggcagccatcgtgccaactacagcgatgacgactgccatgcaggcctctgtcgcaatgtccatgggcttggttatgccggtgtctggagtctcgatgccccacctcactcctacggtgctttcgaccatgcccaatatctctcgtgggatggagatggccttgatgcaggacgccagtgcttcaggcggcgccatgtatttaatgcccaatgatcaccaccagccactgggcgtttcgggttcagtactgagtaacggcggcatcctcgatcttggagcctccaccgccggcgttgatttgggatatggcgccatgccaatcgatcctcggcagatgtgagtgtcggagagagtcgtcctcgtcctgatcattcttgatttcctcatcttttctccgtcctttgcccctcattctttcgtccgcattgccagcattttgttccgcactacagttccgtatccgtatcgcatcccatccatacccactctttcgctcacccttcgctcttcataccctccctccctcccaagggtcgcttttcgctcgcacggctccccctcatctatatcacgaacatggcactgggtagactgtcggttgttccaatgttttatacccctccaccggttccttcccccccccccccttccctgccgctcatttctcgcgcccatacctctctccacctctccccccacatacctccgtatatttgtacttgattttttttttatttcttatatttttcatatatccaacctcactctcgtcagcaacaaaaaaaagaaaacttcttcctttgtcccttttttttttctttcccatttttcgatattcttttattttgcttgaaaagatcctccagcatctctcattccccccaccaatctttgttccttttttcttttctttttttccttcaataaatattaaaagaaaagaaaagaatgcaaaaacgatgaagagacaatgttctctgtcctctctctctctctctctctctctctgcacttgaaagaaatgaacccgtgtaagatgatgccgttacactctcatttttttttttttttttttttttaccaccaaaagaggtcaaagtggtgctgttgtttcgggaacaagatatccaacatgatttcagcgtcggtcccacccgagaccgagcattctccatagagatccaacatctcggcgatagacaagtctccgaccaataaacgcgtcaaggttaaaggcgcaaactctgctttgaactcgagtggaacttcttggtggcctcgatggagggccgatggtggcaatgctaatggtaatcccttgtctgacggtccttttgcgtttgctgctgctgtggctcctgttgctgttgctacagctgcagctgcagctgcagccgactcggcttcgttttgtcgggcgatgcgttcgcgtgcagcgagcatgagctcgtacggcgtgggcggcacccactcatccgaggcagagaggatctgaccctggtcaaagatgatttccaagcccttgccggccgaaccctcgacttggcggaagaaatcaaagtgccaggtgaccgagatgccggcgagacaggattttgcgagacggtcttggagcgtgggggcgatggtgaggataaacgcggcgtaggaggggatgcgggtgtagagacggtaacgctttcggaaaggggtgagttttggttggagaagttgggtgaccgggtgggtgggactgagcatgatgcggcaggaatgaagcttgtccttgcgtccgggtgccaccactgtgtctgcgtcagcaacagcagcagcagcagcagcagcagtgggagtgggattggtagtggtttgattctggtggacgttttcgttctcttgtggttccacagcaggtgcgtggtcgtctgcgttttgagagtcctttccgtctttgacctcttttggctggctcttttccttcttcaagtcaaagatggtaggttgctggtggacggcaatcatttggcgaaggactgggtagagtgcgtctcggtactgatgacggtgggggtcttggagcgtaaagatgttgaggcagagcagcgaggcaatatgggtcatgaccaggccacagtcctgtcctgtcttggcgtcgacaatgatcctcgtttctcggtttaggtcataattggactgggcggtttggcgcagatcatggatcgtgtacctccaatactcctttgtgtaaaacgctcccagatctgcgtgatgctgcagttgctcaggcgtgctcatctggaccaggtacggtatatcgtccaggacaggttctcgcagaagatagggttcggtcttgcccttgggaagggcagggatggcggaggcgaggtgttcaaagacttggtgcttggcgatgctgatggcgtactcgtagccgaactggcgataaaaataagcgatcccgggaatgatctggatcacgtcaccgcgcgcttttgaagccgggtggaccatctcgaggaacaagcggcggattaggccgcggttgcgatagtctaggattgtaataaggtatgctatgagtgtcaatgtctttacaactttgtgcttaccgtgcttgtaggcttcggtccgtcgaaagatctctttcgtccagatgagggggtttacctgggtgggatccgacgcattcgggcgtgccgtattggagctgaactttcccgtagtagcctggcgtggcttgaaggcacatgcaggccacgatggggttttcgccgtccttggcaagggtgttttcgacgacggcataatcgtacacggacatgactgcagagttcccacggaggagtcgtcgaatggcggcgcgaatcttttcgtttggagggggtacctcatcttccctggggtggtcgccaacccactgcaacgaaggcatggtaggaggtcaatggaaggagagaacacgagacgagaaaaaagtatgagcgagcgcctttttttttttgatgaagcatattacgaactgtctgtctgcagagaagtgtgtgtccatgtgtactgtactttgaagacctcggcgagacatccggcgatgttctctgcatctgcttgggtagaccatcgcataacgagtccgtcgccgatttcgattctttcaggacgtttgcttggagtggtgtcgcgcgcggcactactcacgtctgaaggattatcaactgtcatggtgttcagatacttttcggattgcgaggattttttggagcagagagatagtgagcgaaacagagagagatgaagagtgtgagagagatagagagagagagagtgagtgagtgagtgagtgagcgaaaggcggcggcggcgttgaagcactttcaatttatgagagcgaggcagggtagcttgacgctgctcgtggtctgtgtgtaaccaggtcgttgttggatcgaggccatattggggaaagacatctttcccatgactccatccaacgaatacacgtattaaggcgacaggaggtttttttcttgttcttcgtgttatgaagctgtaccttggcacagacttgattcttggctcaagaaaaatcaaagccgacaggctcccgatttggacaagttcaaagggcacactgcggcgcgtgggttgcatttttatggtttgttcgccaggagtagagagagcccctgctgccaagacatccatgcccagtgcacgcaacgcagccggttactgggcgctgccagtggtcagttatggagatgtttttggactaggggtgcgtggactgtctacggtgaacacgcagatggaggcgcagggacccttcataccgcaaggggatcgctgcaagtgcttgctgcgtgtgcaacatggctgctggctgtctaaggttcaagcgtatgcaacgcacgtaagagggggaggggcaacaataggagcaggccaaaggaaaatcatccttgatcgactgcgatgatcgtagagagcgagagagagagagagagggagaggagaagcgaatagcaaaagcgcgatttcctttttgggcgcagtggggattgcttcgtgcaggctcggaccgcaatgagcagtccaggtaaacagagtatacgaagggcagtccttctagcctgccctgggagggcttatgtgtccggtgtaatggggggaacgggggcctttttttttctttttcttttttccttttatgtagtttgtgcaagggtaaacgagcacacacacacacacacacacaccttgacacccccactccacacctttctttccctccgatcctcattcccaccccttcctcatccgcttcctgctgccgcgcgctctctctaccgccctctcctctcgctctctcattccccactctggctcgtgccctgtccgtcgctcctgatctcttctcgcccgtcctccccagcctttccaagcgacatccgcaccacgcctctgctctgaccacgcactcgtctctggctatgagtgcttccaccgctgctgccgcctcccgcggcaactccatcctcccgtccatcctgccctccacctccgccacaaccagcaccctcggcaagcatggctccttccgcaacaactccaccgccgcccctgccgacagcacggactctactcaaaagaaggtcgccgccgtccagttctcctgggtgcactttcttgctggagggtaagctacaactctttctcgactgttttcactagtcaccttgcagtctagccgctgctgctgctgctgctgctgctttgatgcctgtggatcagtctttgcagaaccctgcagctgaccgttactttttttttttcattgttttttttttttttatttgcttgttttagaacgggtggcatggcaggtgccctggtgacttcgccgctggatgtggtcaagacacgacttcaggtaaactgcagacggacagataccgtcagatatgctatggtatgctgtttgcaaaaggagtattcttacttattctttgtatcccactctcactttgctctctcgacctctagtcctccttataccactctgcagccaatctttctgcagccacggcgcccaggactggaatcgcctcagttgcaggtcacatcaaggacacatgtctcctcctcgggtatgtatctcgccagctagatgtctttacttctgtctctagttgtacttgtggccctgcaatctggaacatggatgcaacagagcgaccaaaagagacgaaagggaaccgagagcgagagagaattccgtggaattgacatcacctgtatccttcctctcatagacacatctactccaaagagggacctcgagcgctctacaaaggactaggacccaacctggtcggagtcatcccagcaaggtaagaaaacaagaccctccacggactgctctgtgcattctggaatcaaccatctgtcaggagtgtatcatcggtactcattctcaatcggtctggaaacacctgttcttttatctcttacccttcagggccatcaactttgcaacatacggcaatggcaagcgattctacactgaactgaacaacggcaaggagactgcgcttgttcacctgtctgcagcaacaacagcgggcgtcgtcacagccacgctgaccaacccgatttggttggtcaagaccaggatgcagcttcaggtggaaggcgtgcgccagtacagaaacagcgtcgactgcattgttcaaattctcaaatcagagggcatccgtggaatgtatcggggcttgagcgcgtcctatcttggcgtggctgagggaacgatccagtgggtgatctatgaaaagttcaagaccacgctcgcagagaggcgaaggctcgccagcctgaacaacccccacgccacccgaggctatgtcgtcggaggcaaggatattgaggaatgggtcgagttcttgggcgccgctggcgctgctaaattcattgcatctgccattacatatccgcacgaggttctcaggacgcgactgagacaggtaccggttgggaacgagcctgcaaagtacacgggcctgaagcagacattccagttgattctcaaggaggaaggcgtggctgccttgtacggtggattgacggcccatatgatgcgtgtcgtgcccaacgctgcgatcatgttcttttgctacgaggccatcatgcaccgctttggataagggcggaggggtgtcttttacagtgtttattttcaggctttcccttctcttgttttctgcttttttttgttttcttttgcagcatccaactcatatcttgcattgtttgttctcctgttttggttgttcttgttcgtgtcatgtctggtcactctccagcgtggaatgttcaagactgaccaaggagaacattcgctccacctcctcttcattttagcacgcatctcgtttaccttgtactatacactatcaaatctctcgtggcctccctttcccctattctgttgaataaatcagaccttgacaattcttttctcttgagcctgtacggtactataaactacggctgaaaacgaagtgatggtgaaatctggcatccatcacagaagatgaagttcatcaccgcagcaaatgcgaatacttaccccgagacgtgggtggcgagtacgttttctcttctactgcctccacatctcgatatcatgttcttatacaacagagtagaattgatactgcgactagacctgaacttttaaaggaggccaagtagttagaaaattctcaacagctcgcttgaaggatctccgccatcaaagggattcaaacaaaaagaggtctatcaacacaaccgaaatatcatatcgtggttcaaagcctattactattactataaccattactattacaataagagtctttgaacctggaggccaaaaaagcccggcaaacctcgccgacgccaactgataccgagaaggtagcaaacctgctgaaggacagccttgaccacatggcccgtgcatgtgttgacatacaggagattaagctgttcggtcttgttgttactggtaagggcaataaagaaaacaaacccctgtgttgtgtctgtcgcccaagctggatcctccttgctaacatgttcttgttatgtgttattgatatttctctttttgtcattaggcgagagagcaactgtgtgcactatggagctgcctgtgaaaggcgtgtatattatgaaaagatacgctggttttttatgtaccgcggtacgaaggatgatcgggcggtcatagcaactgcaatggacgttctcataaatatgagaactgaactggaagctctcatatccaagtgcgaggcacctcggcttaacagccctagcgacagaaccacgaccagctatcgaaacccctcaaaaagtggagcggaccggtctgtgagccatccgagacggatcgccaagcatctgcagccgcaaagcacgggcctaattccgcgatcaggtgatcagtaaaaacgacgggcacggtttcacatacgcggaacatgtcagtcaggccgttgaatttttcttcaactttgaacgcgtttgccaaattcactgttcactcaagatcacaattaagttgcgtggtcaatgtatgtgttttaatggggatgcttttgtttgtttgtttgtttgtttgattttctagccttcgtttcttccctgtgtttgactgaatggatgcttttgttgtcgatataggtagcaggaaagaggagagagagagggcaagtaaactgtgtgccgggggtatgttgaactcatagggccccacgctcgacccagaaagctttggaaaagcccgtgtaccgctcaatctttccctccttgaaaaggtccagctccaccctagctctgagaaagatccttcgacgcgggtccgcgctcatcatgatggtggtcggtcgcaggtacatgaactgaacgtcgctcagcatctcggccgccgcaatatcgtacctcttggccgtcaaggcatcctccacatacacgttgaccgtgccatccaaacccttgcccgactctggaaactcccatgcaaggacatagggtgctcccacaaagaaccgctccttgttgtcgatccagtgcgtgattttcagcgtgcctgcgtcgcgcactgggatgggtgggttgtatcctggatcatccgcatgctcgttccacaactcgagctcctcgtcactctggaaatgattaggatcatccatatgtcgatgaatcgggtcgttcccatggccatggctgtgctcgtcctcgcccgcttcaccttgctcgttgtgctcatgatcgtcgtccatgtgcatatccgagggatcggtggactcgtcttcttcctcattctccccgagttccttgcccgtaggtgttgccttattgatatcatcctcatcctcgatctgattctcctccgtgtcgtcatgagcgtcttgagtcttgcggttttgattctggttctgttcctgggccttctctccagtcagtgtcgccgtgttctcgacagtgtcctcatcctcgttttcctcgtgctcatgatcatgatcctcaagatgagtaccctcggaatccttcttctcaagcacctcctcgtcagcaccacggtctgttgaaccctcaggagccatgaaggaagtctctgaggacaggatcggaggcagctgtgaagcctttctccagtccaacgcatgatctttacgaatgacgacagggaagacactcctctggagcaggaccttgttggtcttgccatcgtaagccgtgataatgagtcgagccaacgaccgaatgtcctgcacggtgattgtcgccgttgtggagttgcctgcattcgtcgtcgctactgttttcgagttggtgaggaccatcgtgatattggccaggtcctggttcgtgttgccaccctcgccctcctgttccttcaacagctgctcccgtgagatcagatcgtagggcacaagaatgtcagagaatctttccgctgcgacaatgtaccgcagcacgggcctcctggtcaacttgagggcgtctgggttggtctccttgtccacggggatcagggccatatcgaatgtggtctcgtctggcaaattaacgtcgacccagctcaatgactccaacgtgcccgaggtccagacatcgtgcggtgctggatttagaattgtaaagtctagcttgcgggtcttgtcatagtgatctgcctcttcttcttcctccgcctcatcgtcctcctcgtcctcctcatcgccattcatatcatcgttgttgttgtcgccattttcgacgcctttcttgggcggggtaggaacgggtattgaggatgagaccgaggtcggcaaagggtcggcgcgtgggtatgggtgtagagcagtcggcaaggactgtgcgggcatcagggctgcggagaggaccagggcaatgactccagctgtgaggagtctttgaacgggcagcagccgagagaagcgactggagcgatgtgatgatgataaggatgccttcattgctgtgctgcgttcctcttgttgctttggtttacgtcgtcttggtgttgacacgggtttcgcgtgggatgactgggattcgagggcgggtcgataatgaacagcgaacaaccgctgatccttgacacctcagcaggagaaaggaaaaaaaaaggagtagcgagggagtgtgcacttggtatattccagtgtatgggtcgtgagacaataaaaattgttaacagaaagtcgcccaggggatcgtaagggcacgggagtcgaggtgagatggggaagaaagggaagaaggggatgaagggaagaagggtcgtggagaggggaatgggtatagtggtgaaagcgcggatggcgaggaatgttcccgtggagagtgatccagggcagatgttcaaaaaggcggtgtggagtggtagaaggtgtgggagtgagagagagagagagagagcaaccggcgggctgaggaagcgagtgacaaaaaataccctgccctttgtgttgactgccacacaagcagatattcatacacacagacagacgcttgcgcactgcctgcaggtggttcacactgcaccttcagttgtacgttcgagtgcatctccgatgagcctattaataacatgccgcattcatcggcagacgaaccagccatgtcctgtcgttgctgagggctcattaaaaaaaatcactttgtcgaagtaaggaaaaacacacacaatcgcccgggctctcacaccggaaggaccagcacccctggctatttgtccctcacactgccccagcaggtggccaccagcccacagtgcagaggtgacatatcaccagcctcatatgagaccaccggcctgataccagagaacttattgaaaaaaaaacagctgaatgtacgtctttctttttgggagacgctcgtcccccgtagggataaaacagagctggacttttagcacaatgggcgtaattgctgagcctggcccctgtgttttgctttttgaggcgtcctttcagcacacaacactgttcttcaaaaataaggacgaagagacgaccgcagcactcaggacgcgctgctgttattggaatgctcctttcgcggaaatttactgacccttgtccgcgtacattgtttgcccaagactttgccctatcgaacagggaggtctcgttgcttgcttcttggaattggggttcatctgtgcgattaagcagcgatgaaaccaggtccggaggtttcggaagtgctgcaagccgaatctaggcaggcttttacatgtacctctcctactccgatgcattgtactgctcgtgttcatcattgtcagtgtcgccgttgctcttaattatctttgcctatatcgaatgcgatagctaggtccgcttctgggaccgtagtgtaatgtggtcacgctggaacgtctgccttactgaaggtgcagtaagtgttgggatggcacgtcgtctgacagacaacacgcacaagctcggcgtgtggtaaacacacaaataaagaagagcagaggagcagttacaagggtggatgagttcacataacatggcatagcctcaagggtcgtctgcagtttcaaagctcatagacgacatgtatgcaggtccgattttggctgaaattgtgccattgtggcatcgcataatctcggggtcggaggaaagcatcgatagacttagtgaggacggaatataaggttatccccgcgttgaggctgtgattcgcttcggccgagaacaatgtccatatctaccatcgtcatcatactggaattgatgcaccaacacctggataccaatgttagttgtgctacggttaccgacgcacggtctggtccaggctggctgtcaaaaaaaagaatgagaaaaagcaatgatttcgaagtagtaggggggggggggctatgcctgacgtctgtggggatgtttcattggtgaaggtgttcagtgaatctctctcactattagcgcgcaggatgctacgcagatctcacgattcttgctgtgatgcaggtgttgtctgatgagaaggagccgatgttgagccgctaactaactggctttcgccatgttacttgacgttgcccttcaatctctgatagcccgtaagttgttactatgaacccacaacagttgctgcgatccagctgttgtctgatgcgacagagctattattgagacgataactgactgactttcgcttcaacttaagagctgccgttttcttcgctcatgttgaactgcttacgtcaagctcccgtaaggctttatcaactgacaattgttgcattcatgagactcagaaatccgtgaggcgactcttcttaaagatgtcggatgtagtctgaaatgctcggcgacgcttcgcaccgaggtgatgtgatgtcagtagttttaaatagtaggctagtgcgctgctctggtccatgagcacaaagttcttgacgaatacaggaaactgaaaagctcggcccatcgactctccgctgtcctcgtgttctcctgcgcccattctatgcaaatacgtgttcattgtgccaacacatcagcgaaatatcactttatcacaggcgaccagttcacatcattcggctagacgtgttgaaattcacgacgagacccttgctctctttctcatttacgtgaacctcttatggaatgacgcattaacgacggctgcgtagcttcctatagtgtagataataccagcactcgccagtgttgcatgttatagaatcagcggcatcaaactagcgatgattaccaggcactctgccatggcgcctatagacgatagctatgggtgcggtggacaagccctggattcggtatgaagattagaattggacgttgatgccaactacattcctagcttcgaggagaaatacaggtagtaatcaaggaattttatgaccgtgccgatagatagcgaagagctttgctaaatagcaatgaaggaagatatgctttactatgaaaaagcgtatggtgttgtgacgagtcccaaaccggagggagaaaggttaatgtacccgcacggatatatgacgaggccacaggagagagggttgacttaggatcagggagcttaagccggcttccacgaacgagaagattctgggaatggccaccggcatcaagaaggacaccctcttgttgaagagcttctatatagcaagtaactctgcaggtaagaatgaaaggtgcacaataacgcatctccatgtatcaatttctcgcatcctcaagcatccctatgatcaaaatccctaggctatctctgcgtaatttccggagacactcggatcactaatcttcaggatggctcattcgtgctgaaaatggttaaagttctcggtgtgcaatcaatgctgatgaactcgtagttacatatctgttgttcttagcattccctggtctcaagacctctgttgacgtcaacaactcggtagaggtacacataggtcctcttaaagaaacgtccgtaacgcgttcaaagccatgccatgggacaggaagcgagcagccaaggcagagccccgtaacgcgttcaggtctatcggtctttgacggtgaaagcagtagcaggatccagaacagtcctgtccgtgatcgagtccagatatgctgcagttcaggcgccaaaaatccatttctagtcggacctctggagtccctcctgcagtgcgtctttgaccactacagcaaccgaaagtacatactcccgatggcaccgaaggagttcccgtccaagaacattgaaatactctttcaggcagcaagacagctgctaaagaaaaatattgaagacaagctggctctgtaagttgaacgctcgtcttagtcagtacagtgcgttggcagaatggtcgacgcgccgcctacactttgtattccaatgcgaaacgtgcttgttgtcgggtcttcatctccggaattgctccttcaagtttctggacaagagatcttccccagtaatttctgcaaggccattgaacaaaagactgcaggcaagcctgaaaaagcctgagctgagctcggctctcaagaaggtcttggatcgcctcttcaaaaatacgtattctgcgaaggaagtcatggacgagatcaccttgatagagtacgaggccatcgagcggcccgaggccggctctaccaagatatcgatggaccgcgcaatgaatagcgacgttgctgcagctctcgagatcattcattatttgtaagagcgaagcacacgaccttactgacgggatagtaacaacgtccttagtttcgaggagaataccaatcaaaaaatgtttgaaaccatgctgaaagcggagagctctgctcgaaagctacgaaggaggatatgcttcacaatgaaaaagcatatgatggtgcagcgagtccccaaaccggaaggagaggggttgataagttagtgtgggtgtacgacaaggccacggaggagatggttcagctggcgttcaatgagcaaaccggcttccttgaatgagaagcttctagctcagacgttgatggggatcaacagggaggaggaagtttcaattagacgacgagggagcctaagcagcgaaacatgtagcagcggcaattgtaaaagtctatggagttgtgcgcagtcttctgggaaacctttagatagtgtctattattcaaaactttttactcattccaagacgagtgcgactatggtctattttgccgggctgatagaggacgaggccacgacttcgggctcttggtgcttcttctcctgaagcgcagacactacggccgtcatgaccgcgacctggcgcacgctgttgatgctctcccagacgcgcttctgctgaattttggctgccttacgggccgccagcttgttgcggcggacgctcgtgggcaccagcgtcgccgtcatctcaaaggaccagcgcttgaatatctgcaccttgaccacatcgaggaggataaagtagatgaacgagatgcacagcacgacaacggcctcacccgctggaaccttgggagtcaatccaccgaaaatgaccatcagcaaggcaatgatctgtgtgccgataatcacaacggcaaagatgggcgagggcaggttctcccaaaagtagccggtcaaacgggtcgaaaagatgacaaagtgaggagcagacgagatgtggaggtacatgatggactcgagcttgcgttgatcctcgggagcgtccgaagcgacgggtgcgtaaccatagaccttccagaagatgaagaagtgggcaaaggacagtgcacagaggcaggcacccagcacgatcgacatggtgatcaactggccgattctccacttgtcaggacggggagagatctgagcattgtccacagcaatgaccagcgtcgccaaatcgttcaggatgcaaatcagaataagcaaatgagcgggcagagaccagtcgtaggccatgacaacgacaaagaagaacatcaggaaatggaccgtggacgtgatacggtagagcgcatacgagcgcatgcgctggaagatggcacgggaggtcatcagaccgtccacaatcgttgacagaccaggagcaagcaagacgatatcggcagcagagcgagcagcatcggtgcatccgtgaacagcaataccgacattggccttcttgagagcaggggcatcattgacaccatcacccgtcattccgacgaggataccgcgcttctggagcaactcgaccacacgatacttgtgctcaggaataacctgggcaaagccgtcagctctgaggacgtgctccgtgatctcgtcctcagacttgtctgaatcgaccaagtggccggcatccaacatgacgcgctgcatacccaggcggtgagcgacctccttggcaatgatcagttggtcaccggtaatcatcttgacagagacacccatatcgttgcagcggcggatagtctcggccgagtcagggcgaggaggatcaatcaacgaaatcataccaatcaactcccacttgtccatgttgccctcaatagtacgggcgacaccgagagcacgaagaccacgcttggcaagagagttgacagctcgcactgcgtcgtcgtcgccaccgacgagacgaatgatgacctgaggagcacccttggcaaccttgaaggacgagttggtgtcgagcttggtgatggtggcctgggtcagctttgtggaggggttgaacggcaagaaggaagtaaccttgaaaccgggcacttcgtgcttgtgggtacgacccttcaagatgtcgagctgttcctcggcagcagtgcggacagcgaactcgatgggatcgttggcaccagcctcagctgcgaggtatgagtacaacaggatgtcgtccgaggtgtagttgttggtcaggtagggctcgtcaaaggtcagctcgttcagggtcaaagttccggtcttgtcggagcatagcacagagacagaggccatctcctcaacagcggtcaaacgcttgacaatgaccttcttggcagcaagctgcttggcgccgaccgccatagtgacagacatgaccgtggggagaccgacaggaatggcagcgacagtgaggacaaggacctttcgaagaacagtcaagaactcgcccttgccatcggcatctccatgaaagtgaaccagctggtagatcataataatgaggaccaggacaacggtgatgaggatcaaaaagtttccgatgcggttgatgatcttttggaagtggccctcctcggttgtgatcgagatcaggttggcagcgcgaccgatgaaagtatcgccgccggtcttcgtgacaacggccatctgctgtccctgcttgacgatggaggacgagtacacggtcttgcccttgttcttggccactggaagcgactctcccgtaagagcagactgatcaatcaggagatcgccctcggtcgcctcacccgtggcaccgatacccagaagacggccatcggcagggacaatatctcccagacgcaagacaatcacatcaccaggaaccagggcggcaacgtccaactcaaccaagtggccgtcacgccagcagcgggtcttcaatgcgagtgtctgacgcagagcatccagagcggactcggccttggactcctcaatgaaaccgatacaagcgttgacgagcaaaagtccgagaatgattccaaaatctagccagtccttgacgacggcagagataatacaggcaacctcaatcaagtaggcaatggctccagtaaagtatccgaggaacttgaggaatgggttgcgcttgacctcggccaactcgttgggtccgaattgctcgagacgagcagtcgcctcagcagtggtcaaaccgtgcgtgggatctgtctggaggagtgcctcgagctctggcgagatctcatccttgtgctcgtggtgctcagcttcctcaacctccagcttgcccttggtatgggcctctgcgtctgtagaatttgatgtatacaatgcgttaatacaccacacttctgaaaatacaataccagagccttactctgagagcagtacagatggaagactggggaaatggatgtgtgcgagggtccaaaggacggatgtaggggtgccgaaaaccaaatgtttggttgcgcgagtgcagagcagattcaccataccttctatcttttcagacatggccgctttgagatatatgtttcctatttacccgcaacgtgtgcttttgaaagggtatgagggggcaatagcttcaacttgtcgatgcgaaaaagctaaaggacaagcgactggtgaacgaggagcggatggtttcgatgagagagaagagaggcggagagaaataaagggagagcgaaaaagagacgaaggatgagagaggatcgaaaacgagaagaggaaaaaaagcaacacaagaaggcaactggtcgttctttatatggttgacgaactgtaccgttatacttcggggtaaacctctgcgacatttgtgtgttcaagtggacgacctaaaatatccaaaaacatcctcgggggtcttctatctagcctattcagtccgtggggaaagggtcaggggcatccgcaacgtccctgcaatcatagccccccgtttcattactccgtattgaataccgtccccttgcgttcgacagcaccagcgtggtcctttggccgtgcaggaacacgactcaacgagcccactttgctaaatcgccatttgggtccccgacaggggtaggcgtccagctggacagcaatcactcgatttactgtgttgtcgatctcgggcagagttcctcacgctgtgctcgagaccctctatttcgcacatcttcactttcattgtcatgtgtgttttacgacgatgacctcctgggccgaacaagatgaacttgatcaagaatggctatttccggctttcgcaccctgatgctgattgttgtatcgtggacataaaacactccatcatactccgactcacggcgactctgaggcctagtgctagctgtttcctcaaaacgatccaagcgttctgtcgttcaagcagcatttccagttgcgttgactgactgcgaactgaacatcaacttgtattgttgacgggcccagactcgtcccgcccgtcctgatgctcagagcttttttggctactgcgtccaataaatactgtgcatctattcaatcaagttgtcacactactttttttttccaggcacaatgtttgcagtgggcgtgactgattggactgaattgagaaatgagaggtaccttacatgttacatgttcgagtggttttttacccctccgtcctgaggcaccaacggatccgtcacacttctgcatactgctgccctcgttgattgctcagaggtgtgagaattttttgctgttgtgcgccgaaacggcaagcgagaaatcaacaaacaaggtcgacctgtaggggttacaagtaaaatggcgaaaactgtccacacacacaagatagagttcgagtccacccagtgtcgaaaggctggatttggaagttgtcaagcagctggaactttctctatagggctcgcattcattccccgcccttgacaaggaggcgccatgttgatgttgcctcacagtcctatagactattggccgtaatattgtgcgtgagcagagtaccgacttgaaaaaaaaaaattgttgcttatacgcaacaggtagcacagtgaatgtttgagggcttttttttttccttgtctattgtgcacagcactcttctcatcatgcgtggcaaactacaccatactcaagataaagcaggcggtaacctggtacagatcactggccttcttgcaaacctggtacacatgagggaattacccagagaccttgctggcggatggagaaataaagactttaagcatctcgccattcttatcggtcataggcatattgagcgtctgagttagagtgcagcagtcggtcgaccgtaaggcaaagaaaaagaaggttacggcctcaattttgccggaacactgtgaggtacactcctgtgctacagtacactggaccttgtccctcatcaaccacatgagcacgaatagttcccccttctgcgcgatggccatctttaaaaagagagagaaacgttagccgccgacacccctatggcatcggcacaagttgaatgtcttgtgaaagaagtcgcggctaggggatgtcatgacccactcactataacagcatcgcagaacgtactacctttgagcaaggcctttgccctcattgaagcaacgtagccttcaggtcgaaagtcaggtacagcagcagaatcttactctcctacagacctcgatctttgggagacggggggacagtgttatccaggcttttttttaaggacagtttcgatcgttgtacaagctgtgacaaatgaaaaaaaaaaatgcctcacgccgtgcttgacgcactgttcacatcgcttttgtccggctgaaccatcgaatccaaatgcggccttgttaaaggccatctttttcttcgttcctgagcctctactgcacatgtgcctgcgccctctcccctccttttgacttcatccctttcttccctgagctcaactgtatgaagcgagcgaattcattttttgtccatgcatcaaaatgtggttgactttcatctccttaacaaaaaaactgaatgaatttcatatcaactgcattcatcccctttccatgtacgaagggctttcattttcaagtgcagtttgcatgtttaatcaggtcctcgaagccatagcaatacatcaaagcaagttgcatgcgtaagacttaaaaaattcaagctgtcgattcagtaacgactctgagtgcactttacttgagaccaagcagaaacaatttccctgcgcaggagtagtgatgatagaatcgtgattacgtttttctgtaggtgctgacctttttttctccagggtcttgcgaggctgaaagcatgatagcccacgtcttggacgggtttgccccgtaaaccagttaccgcgatggagacgcgtgacttcacagcgttactatgtgagtgccttttcctccttgagatccctcgacttttcgtatgcacgtcaattgagcctacctatgatcccacatcacacgcaggctaggaggtacggtactgagacatagcgagaaaaaagccatggcgttctagagctgacccgaggcctctgatcctcccccatacttttggggtaaagttcatagccgtggcttaaagccttgtcgtcatggtgggtctgcaaacccttcaacgcaaagtgttcacagtgaaatctcgcgatagtatgagatcggggtatgttcagtcagctgaagtaccgctgcccaagttctgacagagcgcgaggtaagaacgactggctgcgatacatccactgacccacttttttgcgtacaaggcatgggaaatcaatttcagtccagcaaaactggtaccggtccacaatgcttaggaaactggaccgagaaacgtgtttttcactgtacttgactcaaatacctccgtgaaagtgcgatagtagtgtgtaggcattgctataaaacgttgagccagggaacgtcgtcgagtcatgtttttttcactcgaactcgctcccctctctaccatatcatattgcttagcacctttctgctccttatttttcccactatccgtaatggttaacactctgcgcgtaaagatcaaaggccgacttttagttaacacggcgtgcattgcggcgctccttctcttgggaatggtggcgcatgtcgctcctgtcctggctgcggacagtcgagttgtggctccagtggagtctgcaacgatgaaagtgaaacaaccagcgaaggaccacgagacgatgtacgccggcgttgaggatcttgcttcgcaccatcgctttcaggggcatgatgggcagcctgaagagcgaccccctagcgaagacgaagacgacgacggtaagagatatgtgcgcaacctctacaggcagcaggcgagcttcatgttggtgcgatacaacacgaaaatatggctctagtttcattttttatggtcggcatgaccaagcggacgtgtttttgcagctcctgatttccacctatttgtgctgacttgggtaatcgccttttctcgcggtgatatgtcttacatttcgtctctttcactcaggcaatgatgtagaagacaacgtccctatcgacccgaaatgtctctgcaagaccacgggaactgtaaggaagagcggcggcgctttattactgacttttactcgaaagcaatgactaatcccaatgtgtgatctgatacgccttaccgaccagatctgcggctctacatttgatatgacctgcggttatgtcggcgacgctatcttcaactgcgaagaggttgatgaagagcccgtcctcatcgaacgatgcccctccaagttttgcacgagcggtgagaaggagtgtggcattttaggcccatgcatgtgcaaaggccctggacaggtaacaaggattgctgaccggttaactgtgctgcaacgggttgtcataaacagtgtttcaaaggcgatttgggaaacatttgtaaaaccagctgcatctcgtttcatccatggtagatttgtggttccacctttagcacttcatgccacctcaatgccgactcgctgtattattgctccggagtaggcagcatgccctcggaaattcaatcttgcaaatccgatcccacatccaaatccacaggactgtgtcctcgcgacgcgactggatgtgcgtctaaggtaagggacagggtgctttcatgccaaagtgtcacagcatgccctcatgctttctttattcacaactgttctcgtgtgctttaggacgatcccatcgacccgactggtccttgcgtctgcacccaggctaattcaacagtaagaaatacattctgtttgcatgcagtggtattgatacgagaagacgacgtttgagtatctgatgatttccatcctccacatgaacacactacctttttagacttgcttcagtacttttccggcttcatgtggatacaagactgatggagtgtactgctgcgtgactatcggaaagccgcccgttcttgtggaaacctgttctccgagcaagtgtatccctgtcattggcgatggccttggtcgctgcgacaaagacccgtgcctctgcagttacacgaatgatcgagtacgtcggctcacgctcttacgtgaacgcatgtaacaacacccccaaaaaatacttgatcactcaccatcctattttctccccttgctgatcgtacttgtgcggaacggactttcctgaagagtgcggctacattgctggggcaatttacacttgtccccaacagccggccagaccccagctcgtcagcaagtgccctggagacaaccagtgcgctaacacggaggatggtcctgcgtgtcagccgtaatttgcagccatctgcagccatctgcagccttgcaccccaaaaataaagcacgaaattttggagtgcacaagtgcacccttgtttaaactttggagctcccaagtgctttaaacgtcaccgtgttttttttgtttgttttttttgcccgtccatgcttgcccttcttcacttgacgcctctggtcgcctgtcgctgctccatcgaacggtccttgtctcattcccgtagccactacacagccagggacgcgacacacacaggtgcagcttggagacacacgctgacgacacgcccgtgattgcacacctccacagcacacgcccatggacaccccaagacacgcgctgccccgtcgcgaacggcgcaaggcagcctcgccctatgcgcgtcctaacgatgcctcaaacacattgcgccgccacaaggtaagcagaacccccgcagtctgcgacaagcgacctacaccctcacccgtcttcctcttggcctgctcactttcccgagccctcagcgcacgtctcggctactgtggcggcagagcagagggaggcaaaggagctttttttttactttcgtcaccttgcatgcatcatacggctttgcatgctcatgacaaatggatccactcttttttttggcacctttatcacttattagacacccactccctactggaggaaacgatttgcaagattcataaacccctggagagcagacacagacgatgaggacgaagctgaggcctctgcgacggagaatgaggtggacgacacttctgccggtcaggaagacatggagcaacaggacactccttctggacagcccgaggagaactccgacgctcagggcgtagcagagagtggcgaacccattgaggagatgaaaccccaagaggagaatgcgataccttcgttccctactgagagctcatcggtaacttgcccccctcccattgatccaacgagcatatgtgtgtgtatgaaaatgttcctgacgcgagaaaagagtcggcagcgttttaacccttgtattgtctatgcaatagatgacactagtggagtcgtcttttgaactggtggtgacatccgacgacagcttcatggccgacgacgacactacggctgaccgactgcggcagcacgaacgcgaggaaagtctggttagcggacaggattcggactcgacgcccgatctcagagattcaaagaccaacaaacccaagcgcgactcacgttcatcaacccctgttcgatcgacccggagaaccacacggagccaggcggcaagagccgacgatgacccctctttagagagaagcacgaccctggttgaacaggaaacagctggtcaggaagttggatttaaggctacgagtgagccgacacaggcgccgggtgcagcgtctgtgaccactgaagaccaagctacatcggaaactgttatggccgaagagcaggctgagctcaccaaatccaaaggaggcaagaagaagaagaagggcaagaagcgatccaagaagggcgaggtggaaggccaagtggaagagctggagaaagaaattgcccagtcaaacgaccggattgcggaaaagattcaggagacggaagccctcatcgaggcatccgaagaattgctgcaggatgcaactttgatggacgagggcatctcacgccccttgaacgacgccgtaagcccgttttcggaagagcaggatgcagacgggatggagggcatggtcgaggatgacgatcagacgtttcactcgaccactcagttcgatcccgctgaagatggcgaggacgaggatccacgttatcctgtgatcgagtatgacgacctcaaatatgctgccgaggatgagaacgccgacaccgttaaatactacccgccctcgccatttgcacacgacgaaccagaggacatggaaacaggggctcaagatatcagtgactacgaaagggatcgacatacccccgaggcagatcgggtcaggtcagcggaagccacctatgacgtagacacatttgaaggcagcgaacagagtccatcgcctccttcagcagagcccatgcagtttacagactctgacgaaatcgagttctctcctatgcaaagcccccaactgaaggctgcacgggagccaacttcgcaaccatcaaaggatatccgcttatcgacaccaataccagagcctacaacgccatcctcaaaggagcactttgtggactgcccgccgattgttaccccgaaaaaaccaaagtatagaagggagaagttttcaccctcatcctccgagagcagcttcacgcccaccgacgtccctaaccttttggcgcactttttcgagaaaaagagccggaggggaaagcagctcacacataaccaggccttaacatgccaacaattactcgagacagctgatggtaggtgcatagtggaggggttgttgtgccgcaacctttaagtacctttgcctgtcgctgcctcctgatcggttttaatgacctctctattggcatttcacattagaattcaaagacgatgcatgggaccatagtgaggacggtgtttcattccgggcccagtggactgcaccacgacaggagacgccgatcaaaatcatgaatgcagacaactcccaacaactatcaccttcagcagcggtggcgtctcactctcagtccttggcagtagcggattcacctagacggggtcccgcccccaaaatcgctcgcaagccccgtgcgtccattgcactgagggaagtcggaccagttgcgccattcagcattaaacgccgtgctgaggatgacttgcggagcgagtcatctaaacaagaactggcaccttcactggacgactacttggagattgaaaagtacgccggcgttcagtgggacgacttgcctcagtttattcaaaccaggcgtctcattatttggggtgacaccgatgcacccgatacggtcaagaggcgcaaaatcgaggagaaggagcaggcgcggacgcggaatatcgagattaaggccctcgagaaagagaagagggagaagttggccaaggaagagcaggctgcaaaggaagccaggcacgccatcatacatgtggagagtgatgatgacggcgaagctcacatgtcgcagcaaaagtctaagcgggatcacactttgcggaagcctgcagtggcgcgatcgagtgtggcgtctgtggcagccgctgataacgcagaggatggatcggacatgagtgatgacagagacgtgagtgagagagatggagacgtgcgccaaaagcagtcgggatcaaagtccgaccgtagcttgctgaagcctgcggtggcactggcgagtgtggcttccgtggcagccgcagcagtcgctgaacatcacacagagaacgcaccggatgtgtcgtctgtcgcaaagaagattctggacattatcggaaagagttcaaccaaggcagatgaggaggaaactcccttccccgaggtggtgccagcagccattgagactgtgccagtatccccagtcgagacggcccctatcaaatcccaagcgccatccagcttcgccgcgttcgcctcgcccgccacgtttgcaccatccaccccgtctacctcgaccgtcgcaaccaccgcgaccacctcgaccgccctgttcacaccatccagcgcgtttactccacccagcgtattcacgccattcgcccagcctaccaagtccacgccggtcgcttcttttaccccttccagttcattcgccccgttcaccccgttcgcacctatcgccaccaccactagcgccacccaagacaacgccaagagcgggagtgaggatgagattgaggaggttggctatggattgcctgattacgatgagcgctccgaggacggtactgataaggatgacaacagccaaggaagttacgatcttggggaggagcaagaagacgaggaggaaggcgaggagttcgaagacgaagacgaggatgaggaggatcaattcaactttgagtttggagacgagatctcggatacggagattgcgccggtcgtcctcgacgatgaggacgacgcgcccatgtcacccatctcttggtaaacttttttatccattgatcaaaaaaaataacacaaaaaaattataaaaaaaacgcataaggtcgatactgagaggatgtgtgaaggcaaaggcaagcgtaagttgtgaaacggcattacccgttcaaacgcgacaaggagatgcgaaagatcctggtgaaagcaaacaaggcgatggcagcgagaaaaaaaaaggctcgggcccagtgcacacatcgccaagcaagcatcctttatatcgtgtgcgaatgatctgcagcagatactgcaagcctgcaacttgggatgttaagccattcaaggtcgactagtgttgagcatcccttaaaaagtttgatgatcccaacactcgatctgttgcgaaccggttgggataaacagggccaaggcaggcaccccatccactttcctaacagcgcggccacgcgtgattttcacggcttgagtcgctcttcgaaggcaaatgaattcgtcagaacatcatgctccacaaccattatgccgctttccgactcgcatcaaccttgactatgcaacagcaaatcgtgcctaggtgacacagtgcttgatctgggaagcagcccgttgctcgtcatcgtcgcaggttgtggttgtaaatcgcgttagaaaacaaaatttgctttttttttgtaggacggtgtgcttgattgaccagggggaggagaaaaccacatcgatagctggaatcgtcttgcacatcacggatcatcatgagacgcttctctggatctgaaaagcatatagaaccataggatcggcactgctgcagaatatgggcgatcaagtgccccgtggttcttggaagacaaaaacaccccccccccccgtacaaacacttcttaagggtccttctctatactttgcgtgtatcttcccccttccttctgttgccaccaggccactccatatgtagctgtttctctgcttgcgtattctcctagaagatcggcatgcaatccagcgaggacaggctgcagatggacctcgggatcggcgcgctcgtaggaagggaggctgtgtccatcatcatggcgatcagtggagaaaggaacacgattctccttgttgcgtgtacaaaggtcgcgagaaaagaggtgaacgcgatcaagtgtgctactgcagccatgcgtggcgtgcagcaattcaacgcgcgagtgagtgagataagcagagggagagagaagcagagaaagagagagaaagtgagcgagaaagagagagaagaacaagggaagaaaaaaagaagagcaggacctgatgcgcccacacgtgcgtgcacctgcagcgggtgtcgatcacgaagtgagggggccatgcagcggggcgcgctctctatctgcacacgcaccccctggcaccaatcaaggccctttgcctgcgcaagagccaagtccaagaaacaaaagaaaaaaagagtccagcgagtcaacagacgcacaaacacaccacacacaacaacaacattgaattgccagccagccagccagcgcgcacacgcaccagtcagagcgaggcgaggcgtgtcccttggcccgcggggtgtgctctccatccctcacggccagtgggatatctcgcctgcggtctgttgtgttctttttttttttttttgcctgctcgctcctgtgcccatcccatcccgcctgtcccatccgtccatccattcatccattcatcctttgccttcgcgctccatccgtccatcctctccatcctccatcctccatccttcatccttcaaccttcatccctcatcctcatcctcacagtcatcctcctcccactcaccagcctagccctttggctgtcgcccccttttccaacccacccactgtcctccacccagcccttggcgtcccccttggcgtcccttgccttttcacctctgacgtcccttttggccccacacccccgcgtctctttcttgtactcgttctcgttctctgtctctgtcgttctctctcttcctctcttttcttttttcctctttcctcctcgccttgacctggccagacactctgctgctcgacccccaaaacagccgcgtgcctctctcaactccatcgacctcgtcaggccgcgcgatcctcggcgaccagctcagggtgcgtggctcaggacagacatgctcccgtcgcgcagcagcgatccaccttgtgcacactctaaccgtcccatggacaccctttttgcaccgtataggtcatggacactgaaagcttcccagcacagcagagcttgacttcatcaaaagccaatgccgcgcctaccagcagcaacgtcagcaaccaccctatccctcccggagatgcagcagcagctgacgccaaagtcgaaccagcgccagctgatgaaccaacactaccgccctctgaccctggaacccactccgcgccctcgcaggccagacggagaagagtgtcgttcagggttcagaacaggcccgcacagctgatcaggaatctccacgccaactacttcaaccgccaccagcaggaggccgtcgcgcccgactcccccacgtccaccgccgccagggtcgtgcagtcgattcgcggcaatgtgtttgtgtttggcgccgtcgtgtccatggctggatgtgcagttctgctcgggcagcggtacgcaggatacacgtggcatgggatagggcactcgggactcgtggcccaggtcgcgtaccacggcctgtttgcagcagcgtgctcttggcagtggctcaagcggatggcgttcagcatcgacgccgaggacacggacagggacacctcagagtgtgacggggacttgtacagtaacagcgtcaatcgggccgggtcctgcagccccgtccatgacccagccccgtcggagccagtggacgcccccgactcctttgtgaccagtgacagcaatgccgcctccccgggatcgtcatcccctcatctcgaagctctctcctcctcgcccgtcttgtcttactgcatctttggatacggtctgctcggcctctttggactcacccctgcattggcggcccatggaaaaagttcgttgggttggaacccaatcttgctgctgtccatccttgcacccgtgatcgtgggtccatgtctgtggggtctcgataccatctcgcgtgccttgtcaacggatttggaacgccaaacggccgagacagacgagctctgggagcgccatgaaagtttgctcgaggcctatcgggacgacaatctcttgaaaaagaacattttgctcgagaccgtcggcaaggaggtgcaagacgcagccacgctcgcgatcgaaaccctacgccagatgactcccagcagtctctttcctcccagcatctcgagagagcaattgagcccttgcacgttgccaatacccatcaccagcatcctcggcttgttcaccaccatgcgacatctgcaatacatctcgaggaatatgcaacgtctctcacgcgtcatgttcactgaatacgtacaaggaatcgttgaaaagacttcgcctcattaccatcgtggagaaaacagctttgacgttggcgagtttgtccagagtttgggagatctcgtttctgcggacgcgtcgctcaagggcgtcgagctggtcatctaccactccgaatacgatttgaaccacgttcccatcaaaggcagtgaagagagttggagacatgcccttatcaatgtaagtcatatcatgccaaagcggattcagcaaatcgatcggctcgactggagactgcgcgctttgctgctatcccacctgctttctactcttctcaaacgcagtcactaatactatcgcctctcgaatagctcatcaaaagcatcattgactcggccaaagctggatccacagtggagctctgtctggtcctctttaccattccacagccggaaaaggaaaagaacaaggtgatggtctcattcgaaatcacctactcgcccaatccagattcgccttcgaccgaggacgaccttgcccagctgaatgccctcctggcctccaaactggtgcgtgcaatgggcggttcactggagattgagcagctggagaagcgcgcaaagaggttcattgtttccgtcgaagtcgagatgagccacgtacagcaagaggaaaagattggaaatctcaagcatctggacgaacagcatcggcccgtccatcccttggagacctcaaaggcagaggatgcgacttcactgcccagcgctgtccaagatcgtcttcagcgactggaaagcatgcagacgaccccacccgtgcatgaatctcagcagtttttccagcagcatatcaagacgcctctcgtgtcaccatcacctccgccttcgtcacctccaccacgacgcactggaagcggtagcactgcacggatctctaccgagcccactatcacagaccttgtccgctttagtcgcaagttgtccggcgtgcgggcgattgtcatctcaaaggagcattcagcattcgcagttcgcctggttgggtacttgagggcctggggtctgaacatcatgagacgatctattcccgaaaacggcggcaccccaggagagcccgtgaacgacgtctttttcagcgatgaggcgcaaacacccactggaggcgccaaacggaccaactcgtcgtcgtctttgagtggtaagtatccaggactctctggcaaatccgactcggccttctcgaccgcaaagtctctcaacaatcccgcattcatcatgattgacgacgatgtgagggcgctcagtcaacaaatcctcaggttgcaaaccaacccaccctcgcctgcgcccatgggtggagcacccaaacgcccgacgcatcgacgccagaaatccgtaacatccattcagcacaccagcatcatctatttcactagtcttccaacctttaagcaagcgagggacgccatcatgctgactcttgggacgcaaacgccaggcctgagttatagcatcgccagcactctcatcggaaaccaattagctgcaggacctttgccatacattttggtcctgcccaagccggcaggtccgcgtcgtgtgctgactgcgatccacactgctgttcacgcgccagtcctcgaccagtcctacagccccattgccaccgcaccaacttcgcctgcgcctgtcctccgccactttagcacggaggtcaatccaatggagcgcgatgatattgtgttcgatccagcgacgaatcagtactttgcacggatgggccctcactcgacccagagctcaccaggtggcgtcagccccaacagcggtgtgcctactgatcagcgaatgaagagagacttgttgcggcagttggcggaggctggcggttctgctgaagcggtcgcctatccattcgggcaggcgccctccgagatcgtgactccagacacgccgtactcacttcggtctacaggttcaccggcaggcatccatgttcaagggagtgcgcaacatccggggggtatacaatttaatccgacagctaggcctccagcgctctcaccctctatcggtggacccgcccctcgacggacttccagcggcagtggacgcttctcgtcacaatcgacccccaacggtgaaggaaacatggtgattgctcctccaaacgccggtgcgaactcttcacagagccttgcagccatgtatgcggcccaacgcgcatccgaaactgcagcacccgcgactcccgcaaccaacgccagtcttactcgtctcaacaatcagtttttgcgtccagccggcgctcgatcgcctgcagggacaccaccgctcatcactcacgcgagcggattgttattctctccaccccaagctcgtcaccctatgaattccagtatgaattctggtacggcctcgcccatgcctcagcgacccgacccagtggcattgcgggccaatagcagtggccccaccggcgccctcaacagtcataacctgattgtggacagccacaaggccaatacatccgtgcctcttggcacgtcctgtgcctcgcccttgccatcgtctcctggaccccatagccggcaaggtcccagtctgtcgatgggtggcagtaatcacgacgtatcaagcccaccacctgttaatggcaatgagattccagtggctcgtgcacggagcggtgcaccgagcgtcggcaagaaggtcagggaaacttccaagacctcctcaccttcaactgtcaagagcggagttgtcgagcgtgtcagtcctctggtgaatgtgctcattgtcgaaggtatgatatctttttttttccctgtcctttttactcttgttcgattgctctgatcggttaaggtttctatgatgccaaagaattggatcgttgtttacctaacacctgcatgaaaatgtcctttctctcatgctagataaccccattaatcaaatgattttgatcaagtttatgaggcaacgaaagatcaagtatgacctggcttgcaacggaaaggaggctgtggacaagtggcgcgtcggaggattccatcttgttctggtaagtagctctctcacactctccctggtccactggattttttttttcgctcggatgattttttcggtctcttttgccagaccaacatgcttataccaccacccctgtttaattcgttgttgttgtttttttcctctccgcagatggatattcagatgcctgtgatggacggtatcgaagccacgcgagagattcgtcggctggagaaggctcagaagattggcgtgttttcgaccgacaaacccaactcggtgggcaactcgattcaggccagtctgttggcagcctctgctgcggctaccgctgcagcgactctgacggtcgacaacagtctcgccacgacggccggatccgccacctcgccttccagtagctctacactcacgacgagtccacccgcgtcgccgttcaggtcgccggtcatcattgtggcgttgacggctgaagccgagagtgcggattcgaggaacacggcgctgttggcgggatgcaacgattatatcacgaagccgattgactttgcttggttggagcgcaagattgtggactggggatgcatgcaggcgttgatcgatgtcgatgcatggaaggaatggaagcgagatttggatggcactagtcctggcagtcctggcaggagcggcggtccgtccgcagtgggcggtggaagcctaggtggaggaggtggtggcggcggcggtggtggtgtgagtagtagtcaggtggcggcgctcaagaagacgctcgcgaatgcgggcagtgtgacgagagcgaacctgaagcggccgtcgatcagcgccaggtctatcaagggaagcaaggcgcaggctgctgccgcggtggcagccgcagcggccgccaagagtgccgaggcagcggccgctgttgtggagaaggagaaggagaaggagatgaatggtggggagacggtcgctcagggagcgtcgtcgtctttacccacagcgagttcgacatctgcaacaggacctgaggtgaagccaaactcggagttgttgggagcaggagtaggagcaggagcagacgaaggaggaaaggtgacggcgcttgctgcagagtcttcagcagcagcggaggccaagtcgttgtcctcggtgccctgataacgctgaccgatgagcatgtaaagtataggcccgtttgtcataaagctcgtcaacgtttccttttttttttcttccgcatcaaatattcgcgagacagtggtatgttgccacactctccgagaggtgaaccgtgtttgagggatgatgggtgcgcttattgcgcggaaagagtgtattggtggtatcgttactcaaagataaatatgcattctctgttagagataatgacaaaaagatgcagtcccaacaaataagcactttacatgggtaaagcattttttttatatcaagtgaagtagatatctgaaaagtagaaggctggggattgacaattatgtgggtcccaggctcatcagcatcctagttgtagaggactcacggtaaagaagcaaaagtgatcgatgaaaaaattaaatacagaccaaacctcgttaaatcaaatttcttcttcgctccaatcgctctccccttcctcctcgctgtcagcgccgaactcaagccctgcttcgtacaactcgtggtagtcccgattgatcctgacggtctccttccaaactgctataagttgtgtctcggtcaggcctgtaaagagttccaaaagtcggttccgcaatgacagctctgtctcgtccattcttgggtttgccgcaatcggatttttacccataccccacaccttctcgatcggctggagttcacaatggtatggaggtgtcttgaggatagtatggccatgtctcgatgcgatgttgtagctggtaaactggggaggaatattggcctccttgatatggaaaaggagttcggctttggtgagattcgagccattggcgttggtcggcaggggaagattgttatcgacaaaccacttgcgcacatcgtcgaccttagtctgcgaattcggaagcgaattctccttgcgcatgtggtactttgctccgtccatatggatatggcagggtccgtagtcctcctcgagcgtttggcatagaccttcgaaaaggttttcaaagagatcggcgtcgaaatttccatggtaatcagggtaatcaggagcaattccagagttctttacagcatcaggtaccgatcgccacagctcagaatctgctgctctgcttccaagacgaccccgcgcttgtcctttgacgggccggatcaaaaagcttttgcgaatcagctctgatcgcaacttgttgtcaacccggaagaccacaaaagctccaaaaatcaccagcattggcttccggccacgctcgttgactacaccgcctggaaggtcgcagtagaactcatccaagaatacttcaggcaagattggtagtccattggcattcaaattggatagtcgacgttcaacatacaagttccggtagtcaatgacgctctgggagtcatggagaatattctgacgggcgcctttcccgtagtggaacttgagcttcttgaggtatcgaatgagagtccgcttgtggattatgatgtcgtgcttgcttgccagttcacttagaagtatgttggaggagacagggttgcccgttttgtttccttccagaatgactgttcgaatcgcaatgatcagttcatggcctattctgacctttggccgcccgatgttgacagagtcattagggtcttccttattcgtgtacaaccgaatcgcttcttgcgccaccgtggttccgaccccagctgcaatggcaagacgcttgcggggtgtggccgacttgcgagaagcgagtaagggtccagaggcagaaaggtagtgatgaaagctcattaaaatgcaatactcattgcgagtgagtggtgcagcattgcgcttgaaatgggctttagatatcggatcgagatgtggatttcacgagcggatgttggaggtccagaggagcaagtcttttcgctttccacctctgtaaatgtcatatattaaagcagccgcttattcaaagacaaacttgcaaatttagggttgcatcttgtcactatctctactcagatagtgtttgagtagggccaatgatattcttattttatcctgaaatacatatcatgccgccttgcctgcttcccggcagacctcggggatggggatggcatctccagcagtctcgccgcactccaaaatctcttctacaagctggactagatccagttctcgaattgtcggtgggttcaacaccacgcggaagaagaccggcaggtatggtcccaggggtgcaaaatcaatcataaatcgtccccgtcctcggatctgcgcgtgaatggtcttcgtaacccgttccatccatgccttcgcctcatcacagtccttgaggtcggtcaaaatagctccatcatctcctgtgctgcatgtggctgtggtcgcgacggacgagcttgaagatgaaaccgagctggaggacaccagcgaaatggctgacatgcttggcgagatcatatctgtggatgtcaatggaattgctggtgaatccaatgtacctccggatgagagataaggcagatttgttggctcatgctgtgcagacactgcggagggagtgagctttgacggaggctcggggtatgactctcggaggcctctccaaacccgctcagaacctcgccagtcgaccttccggctgcctttaggccgataccagaagcagacctgtagaaggctgggctgggtcctatcacgcccagccttcgtgtcctcatcgtccgtgtcgcttccaagtctcagcatttgaattctttggtccctaaagtcatcctgagccagtaactctatgaagcgcgcgacattggacaatgacttttcaatcctggattggtatcccagcttgccataatacttccaccccaaaaacagcttgaccgcatccgagcgtcgaccacaccccaaggtgccgtcaccgagatcgtgactctgcccatgaaagagataattggcattcaacgcattcgcccgtgggaaaacagttgtatcctgaacgagtaatagtgagcactgaagcgaggtctgtagcatcttgtgcgggttgattgtgatagactgggcctgatatcaaaaaaagagcagtgatgttaattttaatccgctcgcgcgcgaatcgctgtcgttcctgaacaaagacgtcgccataacctaccaattctgagccatcgagtaatgaactggcgagctctgggacaaaaacgacgcaaccaccccaggatccatcgatatgcaaccagcaaccgaacttcttggcaatctcggcacagggtctaattggatcgaaggcgccgagaacagtcgttcccgcggttacattaacgaagaagggcgtgtgtcccaagtcaatgtgctcttgaatgagtcgctctaaggttgtacaacggttacaacgaaaaggtatggttgagcattacgattcacaacaaaaattcagctagttccttctgggagaagcagatcatgcaatggcttacccagttctgaaggaatcattgctccgtaagaatcgcatggtacgcttacgatgctctcagtacctaggcccatgatgacagccgacttctcgagcgaataatgcccagcgctgctcgtgaatgcaattaatcgtccatacgacgatgcggacgagcctgggtggtacgcatgcccttggcttcggagcctttcctgctgaattaacgatggccttggaaagtaaccatatttcttgatctctggaaagagagagttcctggctgtaaccatcgctagctgattactggcgcttcctcccgggcacgatagacctcctgctagctctccttggaagccaaagagccttgcgagtgctcttgtcacatgaatttccatgagggtgaacacaggcgagacatggtatacgtgtgagttcccgttcagtccagcgaggaggagttcggccaggacgccgatcggtgatgagccggcgtacagcttgtccatgaaccggggcgaaaaggtgttgacgctgtactgcagggtctgggtcacggtaggaaagatgcctaagcgcggagaatgaccaaaaaaaaatgagttaaggatgcgggctgcaattcggttacacatgcaggcacgcacatggcagtgactaagaccgtgcaggggcagcaatcacgcaacattggccatgtgtgaccgagtatttaccttctgagccaacgccattgtccggcagcgaaaagtccatgatgcgctccagttcctcgggctccttgtagtcgaccacgagcccgtcgggctgtctgctctgctccatatctgaggcacagtgtggcatgatatgatgaagggtgaaggatcggataaacccagccgtgacaggtgcagacacggagggagtgacattcgattattttttcggatcggccaaataggacaaaagcccatgcgcagcaggaagagaggtgtggataatttgcggtgagtcaaccaacggacgagggccaagcgcagacacaaggggtaaaaaaaagagatctgcagcggaaaaggacagcagccgagtcttacattcgaccaacagatccttcatgcgggtgatgagcttgtccaactcctgcgcatcctcgcagcgctcaacggtgaccattgcgggtgtgtgttggtgtgagtggtgcgaataatgtgggtggtgtgggaggtgcgaggggtgggcaagtccgaagagtgagagtggggcagggcacacaggcgtggaggcagaggagagagaaggtgttgtgcttgttgtgctgcagcgaccggaggagtgcggccagtcaccacagtgcgaacctagtgtgccaaagacgcaaggcaaggtaccctctcgattgggcaagtaccgtaaatatggttcaagtccgcccgcggagggcgcacaaatcccctgcgttcaacgggtcagcgcctcaattcaatgtcgttctcctctacggctgcagcacgtgcgataaccgcatccagccgccctgcgcaagtgggcaccgtctgccgacgtgcgcacagatgaggacgagacaaggcacacaaagacattggctgtgcgtactttttttattccgtaaaagtcgcaactaaaaatacaaaggcagttgcagtgctaaatccgaacaatggctgcaacaccctcctccgaacctgctgcctcggcttccttacggaaccagtattcctcgcagtcgtccttgccaactcctgattcatgagtaatcgtcaggaatgtaactggcctatcggtcacgatcatggggtggtgccacacatttggcttgtagttgatgccctggctgttcttgaccgtgaaggccttgagcgtcgacatgtcgggcatcccatccgaggcacggtctttcgcaaccacaacgacaaatccaccgtttccatccccacctatgggcacgaacatctgtgatgagtacggatgcctttcgagcaaacgcacgccgatatcgcgtgtctcgacaggcttgtagcatgaaaagatggcgatgttggcggtcgccaacttgacatcgggtcttggcggcgtcttgtccagtgacttgtttccattctcaaccacggcctcgtcgttgagggcataagatcgccagttcacgaattgaccaatctgagagaacttttcagctgagccttggttcaccttgatcgagtttgggtcgtaggacggcttctcgataatctggccccaaggcgcaaaggcctccttggtgatcggctgtgcctcaaggatgagcaagttccaggtatgctcatcggacagtggttggcgttttccgatcaaagaagtggaagggagaggatttgcgggccaggactgcgacccatacacgcggatgcgcttgattccaccatcaggaatcatcaccaccttgacagacgagatggcagggccagagctaacagactcgggaacatcaaagaaatgttgacgatggggtttaactggtgcctcgctcagcagagtaattgggcgttcttgcaaagtgtcatcagcagtaaagccctgaagggtcacgcttttgggagggttgcccttgtagtgagcagtgtcgatctcaatcaaagtggggtgtccagcagctcccagtctgaacgaacaagaagaaaaagtcaatgtcaagagtccctgttacggttccattgcctcaactttaacatacatgtactcacttgatttggcaccagtcaacgtgtccgacagcccgagagcgtttggtctcccaaccatccgacatatcatgaccgcgacccggaagcaacagattggcggggttaccgaaatgtgcatccgagaagccctcgactctacctccagccccaacagcagccagatcaaacacctcgccagcgtcctgcggcaggacttgatgaacgttgccgtacactctgaggcgagagacaccaccatcagggaacattcggaaacggacgtgggtgtaaaactgagtcgttgggacttctaatttgaagccatggcgtgaatcggggttcaaagcaaccttgggcagaatgggaacccaattcactgactcccagccctcagccgaatctggggccggaatcccgacagcattgttcactttgtcaccagagccaacaacagcaccatctgaagagctggcagccacgaaaccctccacggagacaaaaggggagtggtttcccgtaaagaaagccgtgtcgacctcgaatcccgcgatcgtgcctggataaccaagttcgatcacacacctatgcatgtaaaagtgcatactcaatcagaaatcgtaaaaaagtagcgcaccatacagtcgtcaagcttacagctaagaaaaggcatcaagtcttaccaatcaaagtccggtccatgtcgacgagtctcccagccatcaaaccaagccccgttcgccgtgaaatggcccttgcgagagatgggggctgcagccgtgagcagattatgggactctgcaaaccactcgtcagaagtgtacaggatcttgcctccccgcgttttgacagcaaggtctatttcgtcagagaggcgaaaacaagacgggtgagtaaatagcccaaaagaaaactgccgcggttgggaaggaatggtggacccaaacgatgttggacggaaaagagttgccgtaccgacatagtcttcaaaggcagcattaaggcgcgcagcctcgatcgtctcgtaggcgattgcggcagactttgaggctgcgagagcgatggcggagtctgctggagcagcagtagcagggctgacagcgatgactggggacattggaggcagtattcgaatttcttttcgggtgggtgggtgcagaccgtgcaaaatgttgttttttcggggaagagtgaagataatgcgaagggcttccggtgggtagatgagggacaggtggagaaaagtcggaagagtggagcaatagggcatggtttttatacttgacgaacgacggctgacactaggcttaactacaggagtggtggtggtgggaactgaagcgtttatggggcgagttcgcactccatattctcagggtgggcgactgacatctatcaagaccaagccagcgtagctcgttggagctcatagcattactgtatgcctcaaggtgcctctccgataacccagtcgtatgatatagtctccgagatgagattcaaagtgtggatctaattatgttgtatagaaggtggagtcgtgaatgagggaccacgtttctatattggcgatgggtttttgagagtagaagatgggatataagattacagacatcggtggtaaacgaggctaaaggccctatcggtgtattccatggagaaagtaggagacggcaccgagaatatggaaggattagggacagtacaacagtgctgaccagcactccacaacggattcgacggccaacacgcacgctccatcaaaccttgatgatctttttctagcactgtagcccaacaaaagtgcctgctcaacgcatgactgcttacatcgatgagtcttttcgggccctgttctttgagatgctaaatggtacagtacagtacacttcattcactggctagaaaactagaaaccctcatggatggcctgattctgaacaggaacccatattgtccttgacgctgttccgcccttgcccgtttttctacaaaaatgtatcaatctgccccacaaaagcaaactgtaaaatttgcccgtggaacgcgttcggaagattctcttcagcgcggcccacccactttttgcatcaaatggtgaagtctatacatttaaaaatgcataatatcccgccatttcggcgtctgcagcgtgatctgcttccttctttgccttctgaaaaaacaatcgagggcgcaaatgaattttggagcaaactgaaacaggagcaaattcgatctagggggaagaggtgaaagggggatgccgatggggaatcgccgagcggcgcagatggttttttcggctcttacgccgcacaaaagcgcccaatgcctgagtcacaatatgcacgcccatgttcatttacgattcacccgcggggcgtagcagatgaaatcccggtagattgagcaaacgtaagcagccctgactttcgtttcaagttgccacgtacagacagtccacaagtatactacgtatcatagtgagattctttcctgcgtcgcacagcctcaggtcaccaggaaggagaaggccacattcaaatttggttccgaacttcatatagactataggccatcgtcttcgcagatggagtaataagcgtctacgttttacaaggttgtagtatgcgactaaaaattgaatctaaggtatatatttatatacagtgcggtctgctggtcaaaagtaaaaagtgaatgaacctcggtaaaactggaggtgatcacaagaagaacttctaacagatctgggatttcctcttcgacagcagtgaccttgtccgagttcaacgacagccagtagacaggggcgaagaatgtttcgcgctcaggatcgcttttcggaaatcaattatgcgtcttccgttttgtgaacttgagccgagtgatgcccctgcggcggaaagatatacgcggcgcaaaagatgtcatccacagtgccaaaggcctgtgtttgtggtggatgaggaccctgtctctccatgtccattggttctatggcagagcatcttaccgaaggagagacaaaaaatggacatgcatcatcccccttacagggaggatttgtttgtttgtttgtttgtttgtacgacgaatggcccattgatatccctccttatgatgcttatgacgaccacagtagcgtccttgaatgagcacctaaaaaaaaggcatccctcacaagcgaataaacatattttgggcaagggctgcgtaaaataactatggtaaacaaaccatagtgaactgggcagagtggagtacgaattctgtttttaatacccttgccaatgaataatcgatcatggaccgttggagttggagttgagaatgtacagtaacaaatcttcgcatagatcgtaagcccgagttaggtcgagcggtcggatagcaaagcgaaaagacaagacgagttttgtttccctctaacaaggttgaccgaggggttcaagtctcagagctaagcgacccatcaaagacataccgtgcggtaccatgaggaacagcttagggcaaaagctcagaaggatatcaaaaagagggcgtgcaaggtctcttgctatcgtatgttcatgaatatgcagagtcgtcaggattggtgtgctattcgtggctattagccatagagcagctccagactgcagacggagctcaatgtgcactttcagatatgcagagaagggttaccccagttcgtgtatgcatccggctgattgcaacaattttgtctcatcgactggttgtcatcggtgacgacgaacaccaagacccaaagccgtgaaagcagcaaataaatagcacgacaatgatggcaccttctttgtgggaacaaagaagaacctagatccgatgacatatctgttaccgacctgggaaagtcagtgagagcagcacagttgagagagaccaagagcaccatgccaaagagccatgactctgggcatgaaaaaaaaaaaaaaaaaaaaaaaaggcaggcggcagcaagaaagcagaagggcaggcggcataaagggtgacagacagggccaaaaaaattcttctggacattcgaaatcaatttattcactaaattagaaacgagctgaggcacctatcgcatctcgttgcgactctattgattcagactaatttaaccctccagacgtatatataccatccacaccccttgttcgctctgccgcacaccttttttttttctttgcacatctctttctttcgacctgctctctctctcactctctctctctttcttctctctgtctgtcgctttacgattttccctcgttacacttggccttccagcaactcttctcctacagacacaatggcaaagacaaccccacccccatcgctgtccataaggacgctgttcacccctacgacattcgtctgcctcctcgcactcacgctctgcacaccaacctccactacagctctgcctatcggtgcctcaccagtctctgcctctgccgccggctcttcctccgcaataccctctcccaaccgcctgcgacgcgactcgggcctcagggttgacaccacatccacacactccacagacgcaccttctatcgcctcggcaccacctgcactgtcttcgagtggcacccctttccgcaccgtctcccgaccaatcaccatcaaagtcgatctctctgcatcctcacctccctcctccaaaagcgatccatcctatgccctcatgatccaacgcacggagcagcaggagcagttcctccgccagcaggagctccagaccaaggaggagctatcgaagctacaggaggagcaggatcagcttgagaaggaggagcaagatcgggaccaactcctcgacaacgaagaggagtctctccttgaccaagaccctgaaaccgttcgacgaaggcaagaagagtcgctgggactttggatgaccgactccgagtacgatgccttgaaccaaggccccaacagcaacagcaacgagcccagccacaatagtccattcgatctttacgcagacgacttcaaggaggtccaaggggtcgtcgaaaggagtgacgaggagcgcctaagcgcttcatcgtcccccttggtgcagtctcggaggtccgcgactgcctcctctttgctctctaccagaaaaggccagcgacttcagcagcgtcaaattcctactgaggaggagatgctcaactggcctgttgttaacgcagcccagttcgaagagcgccaggatgagcagcaagacgaatacgaatacgacgacttggtttaaacagaacgcgcttgatactcaagccccttcctctgtcgcacctcccctttattttttttttacttttgcccaagacaatgggcacactcccctcgtttctgcaagctagggatgagttgtatcaacgtagcacacaattgtaaaacacccacgcatttcttcgtctttccttgaggctagcttttgttggtgtgcacttccggttcacatcagtcattccccgccaaataaggtccttaccatgctgccatcacggctcatctagattatacctttgccctctcttccttgtacataaacaacccatcgtttcccttgagaattaaaaaaaacaaaaaaaaaaaatgccaagtgtcgaaaacgagccagacaggtactcatttcttgacagatccctttttgacagggcgcactttgaatgaaatgtagtccaacatggtagtatgaaaagacagactatgacgcgaatgtacatgtactggtcttggggcgaaaagggctcatcgctgtgggaccaatgcagtcgtcgccatattcgcatgaatctgtgagcgtggcagggtatgctagctcagtatcagggtctatgtccagagagtctacgcatgcgatagatgcgatagcgtaattagtgcgcttgcgtaaattgagagcggtaaaaatcattatcttcctcgccaacaaatggcgcacggaaagttcaacctcgtgggtgtttcctgtctcagccgtcagtcagagcttttttcaggcacggtgtcttgaacgaaaatctcgaaaatccgaagtggaggtgcgagcgcagaggtccatgagagtcagacaggggtgggtggagggcatgatagttcgttcactcagagcttttttcaggcacggtgtcttgaacgaaaatctcgaaaatccgaagtggaggtgcgagcccagaggtccatgagagtcagacaggggtgggtggagggcatgatgttgacacatgagcttcccttgggcaccggcagcaactatcgcaggttgggttccattgataacgcattcattttgactggacctcctttacaacaacaactgaattggagactgcttgaaccgctttgttttcgctttgttttcgccgcacccaggtgcgagctcaactacatactatgtagctacgtctcaggtctcgagccttgaagaccacacatagcatgagagacttggaacagtacttaatggaatgtttgccttgtatcaccgaaacgcatatgtgcctttagctcatgttcgtagactatgctattgtggaggatagttagactgtggtgcagagatacacaacccttggcattgaagaatggccttacacctttttggaaatgtagtttgagaacccttccaggcacttccacaaatcgggctcattcactgtcagggtgcatgcgctaagcgatgatgctaagcgccaacagctagtctatacccagctggatgctgtagtggatgtgactcttatgctctacgcggtggactgaaaatactcaatacacacggacaagcaaactcgctctaatgtggtttttgaatcgaaacggcttttctgggcaggccgttctcagaaggtcatgcctttcgctacaatgttacaagttgcgccttagcgtggcattcagcaatagtagttccttgtttctccaacaaaagttcgtgagtacctggtgtggatacgcttggccaccctttgcagagctttcgagggcagtcgacttatcaaagctctgcgactagaagacgtgtctttttttgatgaaaacgagaaaaaggaagattccaatgtaactgcgtgagatatagacacactttgcctgtgcgtcgacgggtgcgaccggtctataccatgctatgcactactttctcggggctatcattatgtcaagtagacacttgtttgtaatgatgctcgatcgaatgcgcgttctaggggacgtggcgatggatctgcacctcgcgcaaggttgaattttgtttgcaaatgtaccacagtcgatgctagtatggtaacgaggaatggtttacatgtgctttttgtatttatgacggtcaagaaaagttcccatagattcagcatccggcaaacgttacataaatgccagagctgacaaagtaacaccgctccttacaatcactgttgcatctactacgcagacgaattgcaatcaccatacttcctcagcaaccaatatggtattctttactagttcgatacttatggcaatggctgctgcatggtggaaagggaaaaggttagtttgccgtaacaatttgtccaagccttttgggcttagacggcggatctcaacacaacgcatgcatgttctctggcttggagtttagaatgcatgcatgagggcccagtgttttcaagacgtcaagtatcgagacggacatgtacaaaagtgctgatccctgcgttgacttcaacgcgtacgcctgtaaggatcaaattaccagctaaattccgtgtatcaatgcgataccctgctcacattgtatgtctcgtttttcaatcttgtaaattgatggcacctaggcggtagattttcagagaggactgataattagacgtttcccgaattaccaacaagctcaagttgctgcgagagaaaaacatggtaggcaattctcccatatcttggtttgtagaatcgaaggccgagcatgaattcattctaataaccggaactcaattcacttttcagtatttcattcgcactatcgtcgacacgaacgacctccatttcggagaagagacagctgatgaagttgtcaggcgcttcaacctcaagaagcctcgtgatttttacgccagctgcttggacgaagatcaaattgtcaaacgtgggcattacccgctccttactgagatcaggaatattccacgtttcggacggttacttcacgcgctatcaggactatgccatgaggtctcgtatcaccaattttaaattgataagctccgaatccgctgtcgacaaacactcactttcgacgacactcgcttacttcaacaaattggggatggaagcagttctatctctagggacgtttgtggacgtggcgagcccgcaaaagtggattctcaaactggacagcggcggtgttggcatgcttaccgttgatcattatttcatggacgacaaaaaagccgattacattgggttgatcaacaaaatgttcagtcttgtcatgcgtgacgccagcggcaactcttctgcatatacagaaagcagtttaaggacatgggcggaggctgccgaagaacctttctactttgagcgacagcttgtggctctcttgatgctccccaatacccaaacggaagctgctgcagattacactgccgtatctatcaagtctctccacacactaatgccgtcactcgactggtccctgttcattaagacgacactaccggctgatgttaacagagatcgccccgtttacgtgtcctcacaatcgtttctagcgaaccttgaaatacttttggaagaaacctcgccacgcaccctccagagctatttgtctggaatgcaattcgacagctggccagacatcttagtccaatgtacagcgaaatgccaatccatcgaggcgttcgaaggccagggtggccctcgttactcttgacaataatatttgcttctttcttagcttcaacaattcaccaatgccgggcttccagaactataccctcgggcagatgtactttttgtcctacgcacagacatggtgcaacaaacaaagcaccgatggtctagcgaggcaagcgaattttgaagcccttggtcgtaaccagtggcgcgtcaatggcgtccttcgaaattcacccgagtttgccaccgcgtacaaatgcaggcagaggaccttcatgaacccgtccatcaaatgcacgatgtatgtcgtcgagaacgaccagagagagaccgaaggcgaggggaggggcacggagagtggataacatgctttacttggaaagaggtgggttctacgggcatctctcccaggtgatgcgcacacgccctgcatcaatgtgagcaacttttgaaaatgcacctggtgtaaggtcgatatcccccgacttgcatcctgggcactacaagcatcagaaaaaaaaagcctttgttactaaaaaacagaagaaacaaaataaaacgcatattgttgcatgttttcaaaaagggcgaaggtgcttaccatgtccacaatttgcacgtcgacactgccgttcggtcccgtcacgcggatgcattgtccgcacgcgggtgagttgctcgatcttggaaagctgccaaagtcgggtttgttgagcgctgctatcatgtcctgcatggaatttatgtactcaaattcgcaagcacccatcgtaaacttgtccgtaccgactcggacgctaggatctttattttttcaaaaaattgcaatatgaaattttggttggttaatcatcgaacaaagaaagacatacatgcagcgtaaaaataagagtccagagggtcattcacttaccgtagtacgttccttcgccctttccttgcttcgtccagccaccagcattacttcgattgatggggggccgctgaatgccctggttgtgcttctttaggtcatcatctgttgatgtagatccgccccccgatccagtctggccaccaccaccccctattccttcctcgtaatcgccggagccattcttacgacttaggaggacggccagtaggacaataagaaggatgagtagtgtcgtgagtgtgaagagtagcgcagcaaagcgacggcgatgacgagcgacccttggatgtcttgccatgaacgtttcgatgaaagcaggtggcgtgagtttcgagctgttgtagagggattttgagggcggtggtggaggaagcggtggaagcgggtgttgatgttcgtgaaagttcttttcagcaaggatgttagtgccggatgagagtcgggtcaaggagaggggtccatcgtgcggcggaggagctggaggggttgggggaagaggatgctgattttccagttgtgcagaatacgcctgtgatgctgaactatcctggtgagggtatcttgttcctgtgcctgtgcctgtgcctgcgtttgcagctttggctcccgaatacgacgcgctcggcatcaggagtcgttcaagtagaacacgtgagagacgtcaacagcggatgtgaggggcacaggagtggatgtcaattagacaaagggtatagatgcagggtcgagatgaggaatgcgaaagtggagcagttggcgatggatgagcgctgcaccaggtgagactgagtgagagaggacacaacccacggaaataaggttgcgatgtaggtgaaacgcccagggctcactttgactgaggtcaatgagcggggacagcttgcacaggcccgactttgggtgcattacaatgacgtcctgactttggaccttttctgctttatttcattacagcagcatgcgcactaaacactcagtacctcgggtatcgtctgcataaagatcctgactgtccgtcatactcacttgagagggttcttgaccacatagtcaacaaaaaactccatggccttagcaatctcctcgcccaagggcagaatctcctcaggaggcagcacaaagccgttccttccaccgttctccgagggccgcagttcaatagtatacgagtagactctctgcccattgttcgccttggttgccttttcaccatagaaccaatcgctaccggctccagtggtcttgtacagcgccacggaaggctcgctgatgtacttcttgccgtgaacgctctggatcagagagacaatcttgtcaccgacaaatttgtgctctttctcatgcggagaaggagcggttgtccagccttcgggtcggaggaccaactgcgagtaacagtggaagtcaatggcaccgacgatgcgtttctgctcgctaaagaagtcttgcatagccttgacctctggctccgaggcagcatgtggtccacggtaggtctcactccagggaaggttgctggagccaccctcgccaaagtgatcgtcccagttgctgcgcatgggccgagacgagtacagtgagtgatttggatgcatgcttggtcaaggaacataattatatcagtgtgggtagcagcgagaatttaccggttgagatcgacaccgtacatgcccatgccgaccttactgcggttcttgcgccatagccggttgttagtccaagtgtagtcatagccgtccaaattcatgacgggaacaatgacgaactcagtatcacggagaatcgccgtgacgatgtcgttcttgccatagttgctagtaaggtggtgggtaagatattgaacttgtagggcgatagtgcaagaggtcagcggttagtgtgaatatccctgccagctccgtcgacatcgagtggaatttccctcacctgtggatccgccagcccactcgcgggcatgctgactaggatggataagaaaattgcaagggttggcatccgaacaagtgatgaagcaacaattccatgcataagaacaagaggcgcaaggagcacctacagtccttgccaccagatctggggtttttctttgatggagccatcctcttctttagcggtcaacttgatagcaaagatatctcgttcctcgacagtcttgccaatggaggggatgaaggtaatcaggtttggatagtcgtcggcgagctgcaaataaaagtccttaatcttgttgtgaggatggtagttcttgaaccaagtgttcaggtccactctctttttcttgtcggttcccaagacctcggattcgggggagccggatgcgctcagcagttgctggttcacactggccaagtagatctgttctgcgtcatcatcagcgacctgctgaagatctctctcgacaacctgccagtcgttctcaccctcaggaacacctttgaggagcatagccttctcgaacagctcgaactgtttgtcagtgaagtgggcaaggaccatatcatcgctagagcgggaccacacgtcgaggttgtccagaatgctttggatgggatcctctaccagcgagaatgaggacgaggagaagcctgctggaaccggtagctggacgtcattatgcttgcgggcattgaatcgaacaagggcatggtttcgcagctcgcgtgggtaagaaactagtcgccaccatgtatacacgcatttgcagttagtccctgtggagggctgtggtggggcactaaagcttgcgagctcgtattttcaggtccatacttttcttaatgccgaagggctcgtcgtactgctggatacggcttgggccaccctggcgacggccgccaaagaaaagctgaggctcttcaatttccccaaggtccttggtgatagaattctcaggggctgaagcctgagccacgacctgcgtggcaagcacgactactgagagcacagcagtgatactgaggaagtttctcatgacgaattgcagtgggaagtaatgaggatgaggatgacagtggagatgaaagtcgggtgagagaaattcaaaagaagagaagcacataaaagcacttcagaccctgagcagacgagtactctgttgaccctcgacttggcctatcaccactcttctgggaatattgcgccaacgcctgcgtgccaaggtgctccagcacacgaaatgcacagttgactgtgcaaacaggccataaatggtacgcatttcccacacttgcgctggagccgccgcctgcctctctcaggtcctcaaatgaggctctttgaaggttgcactatcctcatatcgtaggcccaaacgcgatccatcacgcacacggcctccctcttgctgcacgactggtgctgggtatcggcccacaggccctgttcacatgaatggtcatgggaatcgacccctttgtttgtggttgcacagcggccacaatcatcacgcggggcccgagaatctcaggcacaggagactccggaaagaataagaacacgtgatatatggagtgtggctttgaagtaaacaaatttaggcagacctgtgggtcgccaggcgcggccacaactgccctcagaggtcttcttgtctccggtcgtattcgcattctccgcatcaccatgtcgcttctccagaccgcctcaagggcagcacagcctgcgcgcagcctggctagccttcgtgcattcagctcgttttctctcacccacccttcctccgtcgcttccacagagtcttccgttgaagcatcggccgcaggcatttcaataactaccctcggtcgcttgggctcatacatctccgagctgatgccctccatcgtctgggcatcagttcccaagagtaagacatcgcattccaagaagcgcatgcgtcaggccaccaaggggctcaaggaacagcggaacattgtccagtgcccgggctgcggacaagccaagctcatgcatcacctttgcacacactgctaccgggacatgaagggtcgtggtccttcctcaaatcctgaggtatagagaaagagcaggacattgtcagttggccaggcacggcgctcgggaagttgttcaacacttttcgttttcaacgggatcagaatgcgatcatagccgttgcaaacactcgttcaaggacgcaacctatttttttttggaggcgcatggaaaccgggagcagaggatcatagacacacacggagcagtattttcttatatcattttctcgttataaactcattcattcacaacggagctatgtcactatccacgtctctggacaatactcgacacaaatcttgggcgacagtgcgagcatgatctgccttggtacatggctcatgtcctggagagagacggcacaaagaacccatcttgtacagggcccgtgctctcggaacctcgtccacagtactggtaccgaatgggctcattgccccatgagataacagcctcttcgaggttccttgcgaacaactctagccgattcagcgtgacagaggctttgcaggcttgcttagcgacttgatctggatctgcgacaacatcccaaggagagactttgtcatgtgcagtagcattggattgtggaaagaactcgttctccaggattttgaaaatggaaggcttccgagagtgctgactgggcacgctgacaagaattcgtctctcgatgccactcggtgtcgcatctgaagagttttgtggcgaagctggtatcttctgtgaaatctttctgccaattataatgccttcatatgcgcgacggtgcttgttttctagactcaggactggtactcctttggttgtgacctacgtgggtcatcagtgttgatatagtgtctgaatgaataattgcgccagacgacgtccatctgatataatggcctgatgcttgcttaccttaagccagtaccaatgcgccactagctcaagaccccaggctggaaacagcttttcgacaaccaccctcttgaccttggcgcggtttgtgacccacactgccacaattcctccgcattcttgttgctcatcctcagtgctggctcttctttttgtccgcaggagatccggcacaggaatcttgaagagatcgtagaggtccatcgtcccgtaatgcgacatgcggtcaacggaggcgttttgccacggcggatccatcactatgatatcgaaaccacctctagtgcttgctaaatggcgtgatggtctggatgagcacgcgttcctcgcaaaaaaacagcaagtatcgctgcatggcagtcaagtaatacctatgtcttttagcccacctattcggcccagatcggatgcgataaatcccgaattgggcggaatcaagtattgtggtagtccttccgctgcaagcgagacaatgtagggttcagcatgttcattcaaaaccagtgtttcgtaaatgtctgccaggtccaatgagcagcgctgctggcccccttctaagagggtctcgttaaacaccactgcctcgttgccctccatgtctcgggtggacgtagttgtaaatccagcactgagcatctggagcattggctggagccccacgaaatccactgaaaagatctcacttgcgggagcatacacgtatgatccatagaagtagtcatgctgcatgctttgaacccacgactgatagccttcctcgcaaagcagcgactttagttcggactgaatccactgcacaatgtcctgatctgtatcaaccgagtccgccggcgaagttccgtttagtcttttccgcttgctccggtgggtgagagtgagaggatgtgttgctggcgatggctgctgggtgagtatattagacgtcgcctccaaagggaaggcaaccgagggtgtttcaggagttgactccacagaggctgagtttgcagccgactggtcgtatggctgagcaacacgaaaggtgccagggcggatgtgccattgtggaaagggctcctgcacaggctccagaagataggtgttaccgaggtggaggacgatgttgcatgtcatttggactgccagtgcccatggagaagcgcacgttgcgaaggaaggtggttcttgaattcacgtacaatcgtggcagctacgtatggcgtatgtgtgccagcgggcaagccaccgtcaaaatatggccacacgccacacccaccgcagactctgaagggcttcgctactgctgattccaactgctccacaccgcacacggacacagacacggacacggacacacatcgcacgcccttgccgcatcgaatctgccagtgctccttcggtctcgagagcgcatccccctacttcggccgctttcctcgctcagcctctgtcctcaccgatttcatgggttcaacacggtccccggctgcccctctggatcacccaccctatacccacgccgccaagcacagatcagcgcccaagagtagtcccgacgaccacgaccacgaccacgacctccaccccacagccgaccgcaccagacgaaagaagaaaaagtcgagaaaggagcgccatggcccctctcacgtgcaccacagtcatcagcacgacgacgacgacgaagaagaccaagacatggaggcagcctcacctcctccagtgctgaagctaccacccatcaagatctcgctgcgattgcccgccaaccccgccattattccccaatcctcatcctcgtcgtcaaagtcagcccgtcatgccagcaatagcaatggctcaacgaaaaaaaagaggcgctcctcagaggtggtcagcagcgtcgtgtctgaggacgacgaggacaataatcggcctcaggctgaagatcagggcgacgatcagcaagagccacagcgaaggaagaagaagcacaagcataagcatagacaccgccatcccaagcatgaggaaccggacgataatgctacgcaagatcgatttgagcaggatctgccaagtgcatggcaaacggatttgtttaacaatcatcatgcagaggacgatcagggcacgcacgagatgttcgattcagcgacagtcagcaccaccgtcaagtcggggacaagggagaaaacgagaggcgagaaaaagtcgtcgacctcatcatcatcacggcgccaacacaccgaggcctcgccagagtttgaaccgcgtctcaaatccagatcacgatcccgatcaacgagccagcatctccaaagcgctccgacccacatcaaaaaagaagagtccctcacgcagcaatcctatcaaaatgaccggactggcagtgtgcatccagggatcggacaaaagcgtccgttttcggccttgcagggacaacggtctcaaagcgcggacacggatttggatgagagtcacatggatgacccactgataggggaattggatgaacctgaagaggacgaagacgatcttgaggaagatgaggatgaggaagacgctgcggaactttcggaaaatgatgactttcgatcacccacaagcgtatcagcagcccgggtgcctttcggatcacaatccgtgcagcattcacacactggatccaagactgtgccatctgcttcaacaggttcaaagcatatggcggaagccggcacatcaaaggatgtcactacgaacgaaggatcagcttcaggtccgaccaggaatgctaggaaaggcaagaactctaggcgtgttttgacgccgaaactaacgacgcctgccatccccaagaaaaaggagctttcagtcgtttgtcacaagctcttggaccagtttatcaggtgcgacgccgctgatttctgctgctttagagatggttactggatcgcgcgtgggttgctaacatgaaatgtcatttgtagacgagactcgtatgtccttttctcgcagcccgtggacattgttgctgtgcccgactatccgactgtgatcaagaaccctatggatctgtcgaccatgcgggccaaggtggagcgcaacttttatccaaacattgacgagtttctcaaagactttcagcttgtttgtgacaacgcgcgactctacaactccaaggagaccctttactggaagcaggccgacaagctgtgggagtggggctccaaagccatcgatcgggaacggaaaacaatactggagaaagacgaagaggtgcttcgaacggtcaaggacgaggaaactttggatatcggcgggatgggcgattacagcaataataacagctcatccagcgcccacggacttgcgagtcgcggacagcttatcagtgcggatggggctgttgatgtaagggccgcttgttcattgtgagcttgttcttcgatgtagtttctatttgctcatgtctgactatgaggcacctttattttcgttcatcattagtcacccgtgccattcggggattcgggaagagcgcacacaccacagcagtacaggaagtccaagaagatcaagcagcgacgtgatggaactatagctcttagctatgcgaccgacggctccatcgatcctgcctcccatcctgacccgtggtcgcttgttcccgtgggaccggatttcggttctactccccaactaagcattttgaacaactcgagcacatattacaatggagcgtacctggatgaatacccctatcggaagacgcctgtcaccacctatcggcttgcaaattacttggactatggaccttatgctaccctcaaggaccctcaagtggatgcctctgcaagtggtgttcaaaatattccggcctacacaggaatggtgtttggagacgagaagggtgaggcgtacgtgcgtagtctggcattgttcttggatggtattgtcgaccaatcggagctggccaagatgaacgaggatgacgctgccggcttgctggaggtacaggaattcatccgcaacaaggtcgagacgctcacacatggtgccagcactatcgtcgacaaggtggcgaccgtagtccgtgaagagagtacaggcaaggcattgggagcggacacccgtgttcctaaggctttatggaaccaagaggtcttcaatgtgaacacgcaggatatagaaacggctgcaaaagttgagggcaagaaaaaggacttacaaccgtcccagcaaacggacgatgcagacatgcaggaagcaagtgagagtgtgggcgagcagtctgctcaggaaaggtcctcaagtgatgccatgatggcggaggcagccgtctacattagcactgaaacgcagaacccttcggaacctgaaatggtcgacatccgcgaggtcgtgaatgagatcaaagcctggcctgccttgttgtccaaaaggaaggattacgaagcatggagacttctgaagattgagctggacaacctgctacccgcaaaccaacgctctgcacaggcatcgactgacacgcccaactcggaaactgacgatgtcaagattctttggggcgaaagatggactggagaggactctgaggatggcaagaagtgggtccgggagtatttggaaaagaactcggaggatatgcggcaggtttttcagttggcaaaggtcaagaaaaacacattgacgactcctgcatcaacggcggcatcatcagtcgccacgtcatcctcatctgtctccaccactgccactgactcctcaagcaccacggatgatcaggagacgcagttgctcgagaggctcatcaagagtattcgtgcgcgtttggcagagctggccaaatatgtgcctttgtcagagatcaaccctcagcgactcccacctccccctgtgcctccaaaatcagcatctgcaccgtcagctcagccagccgaatcgtcgtcgtcttcatcctccgtctcagacaacacagctgcgcctggcacaacagtcgcttcttcgacccctacaacgccctcagcttctggatccaagccatccgcacaaacaacctctgtcgcaactccatccaagacttccgccgcgcctgcaaaaatcgtgacacgggctaccactgcctctcgggcgaaggaaccggccgtgaagtcacccgcctgcagcacacctggtggagattctgcatcgtcgctttcttcacctgggtcttcgccatagacaggatctattgttcctcttttcttctttttcgtgccagttagtattttgtgatcttgtaaaaagaatgtattttagacatcactctatgactcgatatgttgctccagaatgccacacctgttgatgttgcccttgtgggcaccgagtaacttgaacaggaagcggggttacggaggcacgttaaagctgaataaggggcatggaatgagggccagggtttattccggtaaaaaacttgtccgccaaagatagaaacactggtgcagccggtctgcagcaaccataaaataatacacgcaatttatgccgcaaaggcagcattcacgtcaacgggctccctggtgagctgtgtatagttcaagtttatgatgttattaatgagatatgcaagtgagcgggtgggagtggggctaagggttggtggcacaatagaatgtggatgcagaggtgctatggtatgtagctatttacacgattttcttcgatctctccttccttccttcctttctttcgtttccatctccgtctaagcccagagggcgataacagccatggcgatggcacccaaccaaacagcgaccaagtagctggccttgttggctctggactcggcgcggaatcgctcagagtaaagaatatctcctcccaacagcgtaacgtacgcggtgtagatcaagacaccgcaagcaatcgagttgcagatacccatgatgatcaggttctcgacactgttggccttgtaacttgtgcgcatgcccatgccgatggcgattcccacaggcgtaatgagcgcaaagatggtaaccaagaggatgggcatcaagcgtctgcggaacgtcaagtcggcaatgcgggagcccagagcgataccctcaaagaactggtggaagcaaatggcgatcgtcatggccaggaactcggaaccggcgaggacacccaacgagataccgatgaacacagagtggagagtgataccggcctcgagcatgtacgtcgagaccttggtggaaacgccagggccgcattggaggagagtcaagccatgggcgtggttgcagtcgtcctgtagaccctggggcttgttctcgaggctggaggaggaggaagcatgacccacatgatcatgcttatcgccaaagtgggcatgagcattggcctcaagggcatctcctgaggtagcggcgacaacagccttcttgttctgagcttcgaccttgaggacgaggctagaggccaggtattcgatgacgagcatcgtcaatccggacatcatcatgatcaagggagcatatccagggtagtcatccgtccaggccttggagaggcagggatgcgtcaacgcgaagagagcctcgggcatgatatggacaaacgcaacggacaagacgacaccggcaccaaagtacttgccgcactgaacaaagtagcgagtgcgcgggctatcgcgcatgatcataggaaggacgcatccgagaccggcaacgacaataaggacggcaagggcaacaatatgatgccagacaacatactggccttcggcagcgtggttatgatcatcacagacgctgtaaaagaacgcgtcgacagaacttggattagatttccatgccaaaaaaaaaaagacttggtcatatacaagtaagaatgattgattggtatcttaccgagctggtccatgagagtgtcctgcctcagactcttcgtgaccgtgaccctcatgctcatgatcatgcccttcatggtcaccgtggtcatggccttcgtgaccaggggctgcatgatcatgaccttcgtgatcatcgtgggcaggagctgttgcagtgggagtgaccgcgctgagggcgccggtgcccgttgcaggagctccagcagtggtcgtgggagcgggatgatcgtggtcgtgatcgtgacctggttcttgcctcttttgcaaatggctcattgaaaccaattgtgctaccggctccgccactgccgccaaagtcgacacatcgagcgagcttttagatgaagaggaggtggcaagaggtgtgacggaagcgaggaacagcaaggcagcaacggcccttgcgccgtttgagagtctgaacttcatggcgatatatagtagtagtctcaatggaggggcgaatcaacgtcgatctcggtagatattggatgtccaggtaagattaggagaaatgaaaagacgagtgtggagggggggaggggaaggtggctcgggaggtgaaggaggatgaagggagaagataaaccgaggatttaaagtcgagtgtgagctgaagagaacagtgagatgctgacagggggtacccctttggccctttatttaagtatgttttctgctggttgctattgtttcacgggcaaatctccgctcactggccatggaagcgtcggaatctcggtaaaaacgtgcggggggtgagaagaaagaagtggtaagactaatgaggtactcgttctttgtgagtacctcaacggtcatgggccaaatcaggcaacggccaacgaaccatatccttgggcgcaaggggcaccctaatggatgcgaggcacaggatgaagccccgctatgactgggattggcgtttgattcgcgccgtgttgcacatttaacttcaggctgagtaagagaagatagggcgacaaaatggcgccactgacaatcgttatccagcgatgcacggggaggaataatatcttgatgtgacgatccgtcgcagaacgcaacaaacaattcctaggccttgcagatgctgtgtatgggcacggtggccatcccagcccaagtttgatgatatggagaggatgcttggttggcgctgttgcagtgataaaaagacggaaatgggccgcacaagatcggctcttgtttgtcttggtcttacattggcttctgggaggacgaaatgcgcttgatcaaggaccgatgagctcgaacgactgggcaagaccagcgtaaaaaaacgcccatcggagaaacgaggagagaaagccctttccaggaatatcaatgttgcggctgctggctaggttctcaaagacgcggtgcctacagactgatcaaccatcctctacaaaggacatgtcaactaaagatgcctgcgaccctgcacaaggagtttgcttgtgtaatcgcaacagtgattcatcaatttggagtttggtcttcgtgaattggaacagtgaagcgattgttgatgaaataggagcaaacaaaaatctcctttgtttacacttacatgcgaagactgaaagatggtctggagccaagatcgaagatctaaaagtatttggcggcagaacgagagatggtgtcctaaactaaaacaggggatgatgctaatgatgcccagaggacattgttttcgtggttgatgtggtcctgaccaattttcatctacgtcctactcaaggctattgttgttgtttctttgccctcgaagtctagtgaggggaggacacacgatgcctgagcagcattgtgaagactgtcctgttggataaacaggtttaggtccgcactaggtctacagttgcgagggagaaaaattcagaattgtacatcttggtagcaggagtttccctttacttactcttgctgcgttcaacacgtcgcacgccagatttctactggatccactctgcaacatcgatactgaaccgatgctttgccataaaatctcaaatctactctcggtgcctcgacttcttggtctctatacgttcgactcggtcggttaaatactcctactcacattaatacattaatgagatatcttccctgtagctgaaaacatgcgagtcggggcatttcatctcccttgtaatccaattcctgccatttcttccatctgtgtatccctctttcctagtatccgcctcccttaatgtctcctccttatttcaaagtcctctgtgagaagccaaagtgttaagcatgtcggaggtctcatccgactctttcgagagctgtcaagtgttcacaagtgcaagatttgcacattgagctttagagcgaagactgtactctttttttagtttcatcgattggaccccattgacatactgcgtgctagcaatcggcccggaaggtgatgccgcacagaggacgttagtatacgcaggcaacctcccctcccctcatttgtggagatcgtcgaatgagaagcgtcctcctaggtcgtacttggcgcaacataatgtgccacagattggcaatctctccgtgcttagtgattaagaaaaaagcgcgttcactcttgactttccaaacccagcagaagtgctggcgctttttcattctcaggcacgcagaagtgctgatgcagaccctgtatgccttaatttgactatgcctgtgagagaaagagctaaggaagactgtctgctgtattgtatcacagcatgccatttgaaggatgcgtcgtgggaaaaataaagcccgtgcaggcacaaagtcgcggctgctacacgtgcaaaagtatgcaaggcgtgaaaatgcgctcgctggtcacacaatcccaccaggctcgtgactggttgagacaggcagctctttttattttcactttttcccatcatcactctgatcatttcccacacttcctaatccacacattcggccaccctgcttgattctgaccaaggtagcgagacactgcaaagccaagtccgacttgcaggtccctcaggacccagagagcaaagccttagccttttagcattagcctggactctaacccttcgtgttgcttcaatcactcacccgtcgctaggcaggcatttacaagaacaagtaacacctggcaagggcaacaagaacaacacgaacaacaagagtcatcatcaccaccaccaccacaacagcagcagcagcagcagtcgctcatttgcaaccagaacggtacaacccatagagagtgagaagagacaaatccatcaagccatgtacgaagacccaataccccaatatccatcactcaatcaccacagtcatcaatacaacaacaatcatggacatgctgttaatggcaaccacgatacccgggaacagagtagcgatccggcggaccagcaactccagcgactgcaccagcatcaactcctaatccagcttcgtctcgaggtcaactcactccgcactcagattcaacaactcgagctactgaaacagcaactcgttttgcagcgccacatgatgcagccagtcgagtacgagcagctgatggaccagttctccaggacactggcgtctctgttaagtgtgcgccaaccgagtcatggtttcaacgacagcagcccttcaggagaggagcacgccacagaaggtagcagcggtgcaggcgagaggatgtgcgggatgccgatgatggagaagctgcaagagagactaagaagcctaaccatccagcaaaactaccaacagcaacagcaatttcaccaccactactaccaacatagcatggagatggatcacggcggaggaagcagccatagcagttcacggagggatcctgtgagaatggagcagacgagtctagaggcagacctgcgggatctggagaaacgcatgagatcaatacagttgctttgctaaggggggagtcccacttgggtacctatgatgtgtctccagcactcaatgaccggctcacatgtcctacttttttgcgctatttcggaactgtcatgaggtgttttattattttgtggatcgcgaattagaactgttggagaccagtgtatgggaaaagctgacatgaagaaaaaattggccaaaagtgaacgctttgggttgctcaggcccactttccgatcaccgccatggctgccgcgcccagccagagagctgtaaactgaatagcctggtaccgggtgctttcttctctaaaagacctgttggcgttcaactctgtagacatgagttggaccagggccgtgtacaataaaatgcccgccgaacaagcgtcaaacacgccctggacgatcaaggccgtgaccgactcgccgtcatacgaggagcggatgccgatgccaatggcgattcccacaggcgtgctgatggcgaaccagaacgacagcaaccaaggactcatggatgaccgcgcaaacttgagggaggcaatgcggccgcccaaagctacgccctcgaaaaactgatggaacagtagtgcgatcaaaagtgagacgaactcggctccgacagtggtgcccaaggagatgccgatgatgaccgagtgaagggcaatgccaaactccaaaatatatgtgccaatcaagcgggtgcgtttttcctcttgcgcatgggcctgggcctcttcggcaagaagggagctgtcgtgggaattttcagagtggtcttgctggccttggttgtttctgttcaccagaaggatttcgccgccatgaacatgtccgacgtgaacgcacgaatctacgctctcaagtccggccggagtagcgtggccctcctcaagactatcggtgtcggtcacccgaaccttctttttctcgccatgggcatcttgaagtctgtccatagcatgtacacgtgcctgtttttccctctgcagcttgagctccctcgcgcggttaaagaatcgctgtgttgccgtaaactctagcagatggagcagcagggccgatgtcatggcaatgaggcctgcccacccagcataaccagcatcctcatgaaagatttcaggcagggattcgttcgcaagatccgagaatgcggtaggtagcatgtggatgaaagcagtggcgaggatgacaccggagccaaagtttcgggcagtttggatgacagagtggatgcggcctgtcgtcttggcgttaaaggtcgtgtaagcgaacaatattggcaggagaactatgaggcagggcatcaagcaaaaaggttgataaattaggtgccctacacttgtttgcatttcatgtgcagtagcagctcaaacgacgacagggcatacctccaagagcactggcagccatgttggcaaagagtcctccgatatgcaacggcaagttgtaggcctcggggacctcagtaagaggtgtgacggaatcagccatgttagaagggcactatggatggagaggcgggtgtgatgaaagtgtgaagtgatgaaggggccgatggctggaagatgagacaagctggagtgctggataggggtcgagtgggcgacacactaatgaccaaggttcagcggacggtaacgaggaagaggagaagagaaatcgaaggccgggagggagtcggatttttttgagccaccatccgatgcggcgtggcgcccttttatatgatcgaggctagaggcacgcggctgaccatccgcatgcctgtagctccctcgcaaaccgccggacatcggtataacctttgggtgttccttcaggttgcgatggaccaccaggcgtaccttatcagtgaccgctagggtactctgcgagctgtccaaaatgggcgcgcctgtgtcttgtttgagtaaaagaggcaaacaaaaagcagcggagactggaaagagcgctctacttcaacgacgaaaaaggcgcaccactgtccagtgggacagcctagacctggttctggctgttcgacactcagaaggttgcgcacaaagagttgtttgatctaacgccgcaccttcctccgatcgccacagcgaggtgggtcagtctagctgattgagtgagttttcgaagcgatgccaacaaggctaccctttggtggaaagatggcaaatcgaacggcgtattgtttgcgactcagttccaagggcagtaatctcatctaaagcgccactacatttcttctcaagacagcgctaccgcttgatgttgatcgcttactgttcttgaatgaatcagatttattcaaaaagcaacgcagcgttggtttacccgaatcaagcgtgtgcgttcatgaacatgcactgtacctgattgcaaaaagcggatgtaaactgtcgttatgacggagggcggactacaactttgcatggctttgagttcacacggttcttcgcattatcgttttagccctaatctccctctcatctcgctttcatgcgtttgcttagattacccttcgaagacaacggaaccagcgtctttacatgctcccagaagtgagccttacaaaacatattgacaacatcctccggccgtgtgaggcgcgaaccgtcatcgatccattcgcatgtatcctctctttatgcacgaacattgggttcaaagcgcaggcgcacaacggcatgacgcctattttctcacgcccgacttgaacgaggcaagaggcttgactgtgctcctcttacacgtggtagcagcgcaaagctgcaaaggacgttcctcgtcagtcggcaatattaggctatttaactatttgtgttgtccacaagcgttcaagctctgtacagacatgttgagatgctggtataatctcatagtcgctccaaaagctcttgtccagacctcagcatcagcgttagtgcacagatcagatcttgattcgatcgttggtattattcttgcgccgttcatagcactgagatttccagatgctatcgatcttcgcccagctcattcataaaccactcattcccacctcagaaaggccctttttccttccatacctgcaaacttttatagctgtcctgcaaactttttaaagatgttctgcagaggccgccgtgtgatgtgagtggcatgcgcactgcgactctaagctagcctcggcgacgctcggagattcactggaattgacgttgctcggctcaaaagatcacaaaactgcactacttgttcaattctgggcatgctatgatcaggtacaatccacctataccgaagactctccagtctgcgcggacagtttaccgacttactaccaacagccagtaaggaagaaggacaccaagacaggaagcaaagggatcctgtactataaatatctaagcattcacttcacaccgtaaatgtccatatttgtagcaggcaaaggtggaggagagacgtgttcgcaaaccaagaagcactttaaaacagcggttggtcaccgccgtacgagatcatttcttgaccgaaaccatcacatatactcagcttcaaggcatgcatacactcaaattgttgctttgaaatgaccatcgcgcgagcgtgaagtaccctggcaaagtctttactttgcgctgtcttccccgccacatgcacctcacagttcacacactctacaacacagcagtcgcctgccacatactcgcagacgaggctagagaccacgaatttagccttgcttccgaggcttgcactcgtttcagctggtcactcctatgccagcgtaagactagcgagcaccttgccgcgcacttggttagtggttctttcacactgaaaagtcgcatggctgacgcgtttcacctcgacccgcaaagtcatgggaatgcgtgccgcgagccttttccgccttgcaggcctattactccgaggctggcagcaaatagacaatcacactctcatgtcattgtggctgttagtcaactgcgcttgagtactttttttttgacgcgtctctttttcattttgtttacgttttctcgtggagatgcaacttccagccgctggaatcgaacaacagtaacttcttcagtctcttgactatgttcgaaaatcgacatgtataacgtttttgatcgcgatggatgcagctcaggaacgtggaagatcagatcaagtcagcgcggtaggtacgtgtctggttaatgatgtgggttggtatggccagcctactggggagcaagaatcgctcaagcgaggaccgccggacctgaagcagtgagcgttgatgccctttttctaatgaaggccaacggtcccagtcgtcgtttttgttttttgacggtacaagtgaacactttagcgcaagctcgcgtcccccttcatttttgtccttcactggtgtctgcaaactcggtatgatgcaggggaccgacaacctctcctgtcttatccatgagcgtggaatatcaatcaatgggtcacagcgtcctgattcacttcgcgagaatctaagggtggcagcatgcgctcgctcacagcctttgaagaaggacaatggccacatccacttgaagcacccagaggacgcgcttgtgtattcaaggttccaggatacaacggaactcttttgacggcaatgagtacagcatattcgaaaacaatatttaggcaactcacgggcacaggctatcgctaataagtcaaggcctgattgccaattcgctcctgcccatgtaatagtttttgtgtctgttcattttggtcttacaatgataaagaggcgagtgtggggcacgccgccttgagcaggctgtggtgatgccattgaacctggggtcaaagcaatgtaacatgtcgagtatgtgtaaagggacggcgccttctgatcattgtggttgtcgtttttctagcatttcccccgcaactcaccaacgctgcttgtccagcacttgaatacagcaatcatgttgccggctgttcgttctcacacatcaccatattgtatcgagcaagtccgatctgatgtcaagtttatcattagactgttgcaccagatatgcctctattcaatgctcatggaaccgagcggtggtgatgcctcaacgatacatagaaatctgaaggatgcttccaagtttttactgcactcatagtctatatacacacatattgggatccccaattgtcgactatgtcagatgcgtgcctgcattcatcgctccaagagagttccttgacacccctctccacaaaagaaacgatgtatatatataagaaaagttatcaggctcctacgctctcaaagcttgctgtctgcgttggctgaagcagaagtcgacgctgctgaggctgaagctgccgtctgagacgtggcaggccaggagtaggcctgtgaatgcctctcgaatccgaaccgcgacacaaactcgggcagatgcttaggaccccgtgagccgtaagggtaaatctcaacaggcaccagtccgcggtcaatcttgtgcaagactggggtaaagatcctccaagcctcatccaactcgtcgcttctcacaaagttggactgctctcccatgatggcatccaaaatcaagttctcgtacgcatccggtaccgacatgttggggaatctagaatggtaggacagatccagctctgacatcaccgtctccatgccaaggccgggcagcttctgggtcatcttgaggtagacagcctcctcgggctgaactctgataacaagctcgttacgggccgcgacatccttttggaacaagttgttgcccaagtccttgaactggatgcgaatctcaaccttttgctggtccaaggctttgccacacttgaggacgaaggggacgccctcccagcgaggatggttgatgtggaatgctgcagcggcaaaagtggccgtcttgctgcccttggggacggtgtcatcgtcgaggtaagagggcagagagccgtcctcagatttaccgtactggcccaggaggacctcagattcgaccacaggtgggattttgcgaagaacatcaacctaatggcgcgaccaagagatgctgattagatacgttgttctgctattattacatcgcacaccatgatacagaagagcttttccttaccttggcgttgcgaatgtcctcggcgctcagagaggcaggtgcctccatcgcaatcaaggacaggatctggaaaagatcttttaaggagcggtaaaagttttcatagagagcattgttagcctgtggtcccttcttctacagtgtcgtcagtgcgaaaactatgctgatgcagcaatcacttacggttttgcatgacatcgcgcatgataccaaactcatcaaagtagccgccgcggccctcggtaccgatcttttccttgaaggtgatctgaacattcgaaatatgctccttgtcccagcaggagccaaagatctggtttgtaaagcgcaggatcatgatgttcttgaccatctccttgccgaggtagtgatcgatacggtagatctagcgggttatgttgcatggttagctgacgcgcattcctcgcgttcattcgcgcgcatgcataggcgcgtttggtacgactagtcgttatcagacactcaacgaagctgataaaaaaataaaaaaaatgtggccaattgatacaaacaggagtttcaatcgcgccaatcagaaacgtcgccctaatctgccactctcctttcgcactcgcccattcaccacaacctgctctcctctcgccccacccaaaaaaaaaaaacacaaaccatgttggcattggtgaattcggcttgccttctcgagcagcaaccgtctctgaaaatgaggtgtgaagccccgtcacttgctatgggagccttcgtacaacgactcttatcgttttcaaagaactgtgcactagaatcggtaaagattgccccctccctctcctctgctctttgggctaaagctcatgctcgatacacacaataatctgatctgatcgtggcatcgcgcgaaaagaaacctccacgcgtccagttcacaattacctgctccaaatcctaatacacccacaccactgcagctggctctcaatcgccttgtcccatctcacaaaacccagaacgaaagaaaaaattgaagtccagaaagatatcacttgtggttctcccacaatctttttgatggtcacgtcagcgctgtgaaacgtgcgatggggacgtaaacgatggcgatcaccacagatcacgtcagaaataatcgatccagcaatctcttctcaaagcccccctttgctttttcagcccgccccaccagccggctgcgcggttgataggccagctgtggactgcataaaaaaaataaaaaaaaaagtatttctaatcgaccttcaaagtggctaacgcacggtgtacgttcacgctcacgagggatccgaaggcttaatcagcacactcatcgaaaaaaaaagaaaatggcggaagcgactcgcttatctcacaagccgacggtagaagaatcatcctgcgcagacatgcacacgcacgctcttgcactctcactgggaaaaaaaatacatcggctaaagttttcccagctcagtccatcaacgctgcttggaaagcaaagccgcttggcgtgcttcgcctgagccgatcccctcggtttcctgcctcgtgtgtgcgctgcattcaccacgcatcccgcatccttatggttcgatcggaagcctctctccccttgtgttaaacccaacaatgaccccgcattactcatccaatgaaatacagaacgttgtagtcgtttgcctctgagtgtgtgctcccaacaaaacaaaaaatatgaaaaataaaaaaaaaaggagaaacacgaaagtatgcttcaaacatgcgtttgttgcaggtattaaagtgggaggtggggccatcaaagtcatgaagtgttctgtcttctttacctcgtcttctctgtaaagagcgccaagggccttggatagcgtgcgcgaactctcgagatccattccaaaaggcttctcgacaatgagacggttgacaccgcgggtggtatagcagttcttcttcaggccgttcgcgacggggatgaagactgagggtggcagggccatgtagtacaatcgatcgaccgtcttggtctcagcctcgaccctctgcagctccttctcgagagcctggaaaccagagtcctgatcgtacacgccagagacgtaggtgcactggtccaaaaactgatcgagcatggtcttgacctttggtgtggtcgtattcttgatgtactgtgctactcgcttcaaaaagtcgggccgatccatctttgtacgcgcatagcccacgatccgagttgtaggagcgatgtgaccatggaggaagagaccaaacaaggctgggaaagtctttttcttggccagatcacccgaggcaccgaggactagagagcaagcatgagagaacaagagtagcccgtgttactaagcatcgatcagagtgttctttagactgcagcgcagtaggctggatcaagtaagtctcttgacggcacccgctggtaatggctacatggctacgggtgaagacagacgagagtgaaatagcatgtgtcgacttgcctacgacagtgaagacaggccgtccattgatggcagtggtggtggtggaggtcatgtttttgatatgtgcggtacgggggatgttgtgcgagggaagaatttgagaatgaaaagaacagagcgtggaaaaatagtacaaggcgaacaagaaaaaatgcggggtagggtaacagatatgggcttgcgatgaacaagggcagggaatcgatagcgagagtgttgatggccactttaaggagcagcagagggcgttgtgtttttgtgggtggagacgaggaaaggaaagagcgatgcgaaaaagaagaaagaaaagaggatgagcaattcacgaacgagtcagaagaaaaaaaaaacacctgctggccgtgcccactacgctgcatcctgcacaacagcgcaacagcacaccagcaattgacgagcaaatggcgcgagaagcgcggtcacgaaaaacaaaaagtcgttgtttttttgcccagcggagcttggatgtgtcgaatagcacttgcgatggacatcctgcacaaccactgcagccacgcatgagcctatgcaatatcgagcacaagggccagtatgaggtcccaggatcgcatggttcatatctcatgctgaattatgctgggacacggcaggggcatcgagacaatcgagacacggattgatgctgatacgagaagaaaaaaacgactcaatcgcactggtgttttaaggtttggtgtatcgtctggtggcaggcaaccgcctcagtataggatttccctggaattcagccaggtgctcattctgttaagtttgtcgtccactggtgtgagtcaatacgacaagggtccaggacatgtactgtatacaccacagtcctaagttcaggacacaccaggcgacacactggccaaggcgaagggactgctgtgtatatttggaacgctcccaacctgcagtcgctggtggatgtaggtgcactcccctggaagaagaagaagaagagggggggggggggtcttggaaaggtgtatgcaccacaccattgaaatgttggcgagctcagaacgacaaggcaaagctcgaggtcttctcaaaagaaagccaaccaatgtccttttccccgggagcattgtcggccatacatacctcttcctcaacattcttgattccatctcacaagacttgacgtccactattcgctgtctcgacccctcgttggatcgtgtatgcaacttgagcctccagacgctctctttgccttccttgtcccttttctttttctgcagctcttgctctcagtctcaatcgccacccacaagcttgagcgtgcgccatcagcccattgcaagcgcgttgaatatctgcgttttccatcgacgcattgaagcgtccaagaaaggaaaaagaaaaagaatcacacccacttgacgcgacatgattctgaaggccagtcctgcgaattttttgctcgtgctcgcgctcccgttcctgctgctcgagtctgcacctgtctctcagcccacctgcgtccttcctcgccacaccactgccatggacacattccttgcctcgatcaagccccgcctcgaggccgagccctccacgcccgtcattctcgtatccggaaacgaatctgccggtaaggggccttcctgccttggatattctcttgcagtgtgcaatgaccttgacatgaacaaaaaataaaagtacatgaatgctccctcgtgcttacctccatcactcttctcacgcactcttttgctctagacctcgactcgatcgtctcggccgtcaccacctcatacttcctctcccgtctgcagcagtccgttctgggccagtccaatgccatcgtcgtcccattcgtcaacatcgaccgacaggaccttgccctgaggtccgacgtcgattatctcctcgactcgagcaatatcaatacagacgacatctttttccgagaccaactcccccagctagaatccatcctcaagcgtagtccagaccagctctcgctcttcctcgtcgaccacaaccaactcgccctgggcatgtcctccctgagtgccgccaaagtcgtcggcatcatcgatcaccacgtcgacgagggtctctacaaggacacggccaagatcaggaggatcgaaaccgtgggctcctgcgccagtctggtcgcggatctgttcttgaacgacactatcgcactcgaccagaaggacaccgctggcaaaggcaaggcgcagccggactggcttcaacagggcgcccgactcttgcttggacccatcctgatcgatacccggaatctgaacccagagttcaaaaaggtcacgcctctggatatcaagattgctggccagctcatgccctatgctggggacaacacctgtttgaccagcctctttaccaccatcgattctgcccgtcaggacacctccaaactctcgttctatgatctccttcgcaaggattacaaggaatgggctgtgaatcagaccagcacgggggagacgatcctctttggcatcagcagtgtcaatggcgtgatcgacgagctggtggagcgcaatgggaaggaggtcatccaacaggccatgagcaagtgggcctccgagagaggcgtgcagctgttcatggtgctttttggtcacgattttggagccgagaatggaggataccagcgccaaatcatcgtggacccccactcccaggaactgcaggggtttgcggcacaactggagaccgttacagaactgaaactcaagaggacaactgtcttggacaaggatggttttgttgagaggggtgggagggcctatctgcagcaggacagctcattctcacgcaagcagatcgcgccgatcgtcgagaagctgttgacgtcgtcagattcgagaaagtcgaacatgtaggcggctgtacaatacatatatataagtgggatcttccagtgtcctgagttgatagagcaagagcttgcttcctgacaaccttcaactcacgcaaatcaatggcaaggatacaacttttttttttttcttttttaaaatgatactgggctatgctgacgtggtggatgatgcagttgctgtggtaggttctgttgcttgtgaagcaataggcgaggtcgtgacacccggtacggcctgagcatccactcgcttgatctcccagtcgtcatcaatgtcctgtgcctgcagtctccagtactcctcctgcagatccagctttcgcctgttcttggacagcttcagtccttcctccttggacatctatagaggggtagggcaaagatatgatgactgtcagcgactaccctattttgtacaacacactaataatagtgaaaacggttgctgctgcaagaaggtggagaaaagagccattctttacagccttggtcctgttgtcatggacattgtatttggtggcggttaattccgagagcgcaaaggagccaatgacgaccgtgagcacaaagggcagaccaaagtacaggactggtcgcttcttcgtggcctgtgcaaagcgatctgctggtgtggcaacaccgtaggtcttgttggcaaacaccatttgaaacgttgttgaaggcgaggtcctatgggaatgggcggcaggtgaactgatcgctttgtgtgaaagggtcactgacaggagttgtaaggcgtaggaaggactgacgagagactgagagtcctaagatgtgctgcaccgagtagtgtgaagaatgaaggctgtgagtggaggtactggggcgagtgtaacgggcgcaagtgcgccgagagggttgcatgcaaatggagagatcccgggaaagttggggagtcccaaggtcactcagccgcagcggggtgacccaatggctcccgaagctatatctggcagtcccattttattcatcgcgttgagaaagagagaaaaaaaaaccagttcagcgggtcgactctgtgttggtcaccgggatggcatgcttgcccgcaagaataaactcgtatgtcagcggcagatggtccgaccacatgcggcgcgagaacagcatctcatcaaagacatgctcaggctgaggcaccgcatacatgcggtacagcagcttgtccgtgttttgcgaaccaggatgcagcgacgtcggagaggtcgtcgtggccgaggcaccacttgcaaacgtcgccacagagtccagcgacgttcgacggttcagggcaggaggccgaagatgactgtcgccagccagcgggacaccggtccctacgcttgtcaagggagacgtcgaaacaggtggatgtgtgggcgatggcagactagagaaagagaccggtgccgagaacagaccggatcgaacggttgacttgaaagtccgcatagaggcactgtccgatggatcatcctgcaaatgactctgcagctgctctgagatcggtgtagggaccagcagcgaagcagggtcgcgaccgagcggatggtcccactcaaactgatgaagcacgctctcaaacggatgctccttcgtttcctgattctccagctgcttctccaacgtcgtagggcggatccacaacaccttaccagccgggaccagcacaggcgtcaccttgctcatgtctaacccttgcatcctgaactcatgatcgtccgcgtaaaagtcacctccgtcataagtctcctggtacttttccatctcgcgatgcatggcccgtcgaatatccataaactcgtcaaacagatgctcttccttggtcagacgccagcgaatgaccttttgaacaatttcaagcccaatgctctgctgagcaggcttgctctggctcctcttctctcgtctttcacgccttcgtctatcccgtgcctcctgctgttgttgctccgagtgatccacgccttcgccttcttgctccaacagatcctccaaggtctcggacgaatcatgaagtagctcgacttcagtggatgaaggatccatagtcggagaggatggaggggagggcgaagctgaagctggcggcgagggcggtggagttggcctcatggccaacagtgcacgcatcgcatgcccaatgttgcggacacttcccagcgacaaacgtccaacaacgtcgtctccataggagatgctagtgaccagctgtttttgagggaaaaaaaacggccagaattcatgggttagccaggtgacaaaacaacacgcgcttatttcaagtcagagatggcccttcgttaccttgatggcgcgtttgctcagccgtggacacatgatcttgggtgagccataagcgtagcatctgacacggcgacccgggggtagaaacgaatctgcattgttcaggggcaagtatcctgggagataaaagtccctcgcagaccctcccgtcccgcggttcctgtttccactgccactgtttcctagagaatagctcggcatctcaggcgtcagtcccgttgcagggtctgcccagagcatcgacaagaccgaagtaattcctgcgcccaaggagtggccgatcagcagcaacgagtaacctggcctagcctccagtgccgccttgaccttttcctggattccaatcgtctctgcggacgcaatcgtccgggcggccttgaggaacccagtatgaactctgaagggctttctctttcttggtgctgctcctttgctgctgttgcttctggcatcatcattgttgtggtcgatccctggcccataagacacttccacctccacaaggcgttcctccacaacaatattgccgtgcgcatcccgtaacggtgtcgtgtcgtgatcgagccataaatccgcaccatcgcacgttaggtcgatcatcaaatcgtgcagtgactttgtacctcgcagtacaagcacaatctgcttcgtctccacgtcgtccagcaagtaataccgaggactgtaaaatccgtcctgaatcgtcgcagcagtgtcggacgaataaagaatcgagcccaggggtgtgccagtgtagtggtgaaaatgatggtcatccgcgttgttggcggtcgctgcatttgcaacacgctcggacgatgatgctgcggtcgctggcgccggggtcggggttccagaggcagtcgacgggctctccgtaggaacatgaggtgggtaccgctccggtgcacccatgatttccaggaacaacgatccgtacatggctgagcaaaacctcgagaatcggtacgaagcagccaaaaagttggttaattccggatttggcgagctagagttgccgagtcgggctccaggcgacatgtgtgaaaagctggccgcggatcggccctcccgctgttcgcggagttcgagccaccgctcctcctgcagcagttcttcgtcggtcatgccaccgaatccttgaagcgtccattcggctggccaagcaccggtcgcgctccacgctgtactggagcccagctcttcgtcctttgattcgaggcactctcccacagggcggccttgcgtgcgaactcgaatggtctcccactgttccgaggtggcaaactgtatagcgacgtatgccatcagaagacgcatcccttccagtgcagggtatccacctttggccccttcttccccatcggtggctgctgtgaattctcggctgagaatagcccatacctcacgaaaggtctcgcctgtctgtgaagtgctatccgggccaaagagcgtgtccatcagatccagcccatcctgcacagttgtaagcgccaggttcactgaaccatcaacagtctcgaggatcgtttgcacgaggatgtcgctgaagttgattcccaagagcgccgcacggaagggcagagaagccacaaatgccggtgacagtctatgagcatttatgcgagagacacgatccacggctggttagttgaatggaaggaaacgacgagcaaaaaaaaaagggtgacgtgacaatgctgatacgttaccctcgactgccttcatcattttgcccaacagcgcttttgacggcaacgcccaagaccttgtctattcccgaaacaattgtcctggctatacccaaggataggcttgtagagatcatggcaaccttcaaagctgacgaaatggcgacctgagagagagagatgtaggctgaaagagggatcggtcggttgactgagagcgtcatgggtggtgtgttgctgtccgtgctatcaggcgcaggggctgttgagactgtagaaagggttgattggactgcggtggatgccactgttggcacagccactgccgttgcgatggcattcatggttctggtgctatctatggtgtggacgacagagatgtcaatcggtgctgataacgactgctgaagatgaaaacaacttgtacacgtttgcgcacttcaacgttacctaaatgcatgccagtggcagggctgtgctcctcatggtcgtgaccaaaggtgctgcgtgcatgatgcgggctgtgcgagtgctgctccgtctgcacaagagctgggtataagttggatgaagacgaagacatgaccgatgaaaaagaagtgtgaaaaaaaaatgtttgtggaaatcaaaaaaagtgaaaatacagcgccaaggctttttatatttttttaggacgaatgactggcatgtgccaatagccgttcctgactgcactcaaaatgtctcgtgggggaataacgggcgctcaggcgccatgctcaggctgctactctctctcagcactgcaagcaaacccatggcagggaccatgggtcttggcatttccttcccccctccttcaccagcactagtttaaaaagaaactttactgtcgtttggataaagtgaacaagtttatatgttactacaaggactgctcacaaatttgaatctcttctcgcttctcagtcgcgtgcatggaccacaggaacgtgcttcttggcaagatcgtgtctctaaccccatccaaaatgcgaaactgctgcataaactctcatagcacatcagtccacccctgaaatatagctagtcatactcggtactcttgcgatgaatttattattgaacaagtggagtcaacaaacagtggaatgtgtgtgggtaataaaaatgagattgtcctgttgcatggaatcgatcgctgttcatcgctacctctcgtgtcttttcgttttcctttgttttcttgtttttgtttttgttttttttccgttcttttctggttttgttttgaagttcattcgtaaatcaagcatagaatgttactgcttctgcttctcatattgatcgggtgccaacatgctaacaacccgcctcgccaatccaacaatctcgctctcgtcgctagtcaggctgttctcgtcctgttgagaatactgtggtggcgaagaagagtccatagtctgggtcaattgcctgaccgcgggtataatatcggacgagcgcataatgagatcgatcaagtcggcatcgcttccttccaaaaactggacaatagtccagatcgcaatgtgttggaatgtggtgtcagcgctctcgaggaatcgagagaggtagccatgaagtccacccgctggctcctcccatacggtaatgaagggctggtaatcataaatctttgaagaaaggtttccaatcgccgccgcactgttgccctgaacctcaacgctgggagaatccgtgagggggatcaagacatccagcgcgcccagctgaagaagtcttggcttgagctcatctaaagttcgatttaacaaaaaagcaaaagcatgaccgggtgagtgtttcatcagcacgaggcagtcgttttgtaacagcattcacagtgtcattatcaaataaaaaacgatcgtgcctaccactcaaggccaaaactgcgacacaggccgtcatttcagactgcacgctaagaggcacattcaggacgagttcgcacacacgctctactgctcccgcctcgacaatagctctcttgttgcgctcactgcttgctgccaggttgcggagagtcgagatggcgtggcactgaatttcctcgttctcatcataggccagcagggcgatgagcggttcaagaaatcctgcatcaatgataggcgactcgttcagggggtggatggagatgttgcgaatgcatgctacggacgacaggatcaagggcaagaacgtcgactttagcagacggagaagtggcgttaagccccgggaccgaacaatctccagctggtacttttcgtccgaggccagattacgaagggccagggccgcctggcattcgaccttgagactggtcgagtccatgagtccaatgagggagttgacgagcttcgtctcggtctgggccagctttttccggttggcactgtccactgcgatgttgctgagggcggttgtgcaatagtactgcacgtctgtgtcgggggagctcaggagactaaccaggaccgggatggctcctgcgttgaccaactgctgtctgttttcatccgaatgcgtcatgttaagtagggctccagtggcattacgctgtacccgcatgtcctttgaccgtgcaaggcgcgtcaaaggcaccagtgctcctgactttgcgatctttgtcttgttctcatcttgagataacgagttgcaacagcgatcgcgttagatggcataaagatgaaatcacgttatcaaagctgatgaattcacgcacgtaccatgtgtggcgaggttggtgatgcaacccacggcgttgcattgcacctcgacgttaggagagagcatctggcgaataaggggctccaatccaccaagcttgacaataagcaacttgttctcagctatcacaacacgaaatatttgttggtatgttttcctatgcaactttcgattaccccggcaagaaacccatgaggataacaacttactattgacagccaagttgcccagagcagctgatgcagctcgctgaacctccacatcgtgcgactgaagcaggaaaagcacgggctcgagtgtgtcacggtcgacagccctgacatctatgatgaggtgcgcgcaagagcgggagatggtgttgctggtgcgtgagattctgcatgcgctgcaatggttggcgggtcgatgcatcgaggcggcggggaaagggacgtacctttctcagtaatttccgcaaaggcgagggcggcagacctctgcaagtcgacgttgtcagagaatgccagggtcgagagagcacgcagaggatctccttcgaagaagttggtttctgtgcgatctattaaatcatatgacaggaggtcagtatgtcggcacaccgtcatcagcagaggcgtagaaaaaaaaataaaggtgcgggcacgaggtcatatcgcaatccggcatcacaagaaataggagatgtccacaaaaatcacacacacgcacacacacaaagggtaaggtgtgcgcgctctataaagccaaatccagcagcaaataggcacaggcgcagtgtggaagggagaaagggtgcatagtgaggagacaaggggacagaggagcctgaaaagagggcgatcagcggtcaggctagtctcgggacaggtcacagccaaaaaaaaaaaaaaaaaaaaaaaaaaaaaacggccgcagctctttgcgaagactggacagtcgaatgcctcaaggcagtatcatcgccactgaatcgtcgctgagaggaaaaaaagtcctggaggtcctcatgctcctgtgtggcaaggcatattttcccatggtgtccatcctcgttctgtcctgtctttgcttcatcctgtggtgttccgtcgtttgcaccccttgaatatctcttcaccagacaaggagtggcatggtgtgcagtggtatggtgttgcagggacagtaggcccaatcatgcacactttacttcctcgttatgcatatgaggtaactcgcccagacccctcctagacacacccctgtccacagaaaagtaaggaaaccccgtcatacgccgcatcactttgccgacctgtcgcccaagtccacagcttacgcctatgccacgtaatccagaatactccatatttcttttcctttggtcgttcttttatgcctgccaatacttactctccagatactgtagcaagtcggctacagcctcgcgctcgttctcctgaaggaggggttcataaagaccggctcgattgcggtctagtccggtcgaggtaagaagcaagcgtccatggcggcatgaggagacatgagtagagagagcacggggggagaaggacggttcaaggtgggcagcaatattgaaaggccgttaggcaggcgaagggccggttcgacaggcgcaggcacacaaagacgaagcgcaaagtgtggttgattgagtgcgtgggcgagtgagtggttgagattgcgtttaggtaaaaaggcaggtcggggtgtagtgtcacggaacaagagaagagagtttattagaatcacaacccatgggatcacgaagacggacagatgcatcggacttgtcgaggctcttaccggcgcagcaactggaacaggcacccatggaggaaaaggagtcgacgttgttgcttttttagctagagtctgtaaagtagaaaagaaggacagggggggcggtcaaggtcagacgatttgtgctgtattattacgaaaaaggaggcagggaaaacaagtcgagagccctgatgtagtctggtgattgcgtgggtgtgtgtgtgtgtctgcgtgtgggatgggggctgcatgttcgactcgttggaattgctgttgttgtttcttgatgtgatataggtgttgctgttctcgcgttcacatcgccactacgagaagcgacacgcaaagcaccagtccatactgaggtcgaacttggcgaggtgcgactttccgtggaaagcctggccgacgcgacagctcacagtcgtggggtgaaaaggcactgctcacgcaaaacgaaagaaaaacaaagtggcggcaaacacagcgggagtcgagtcaagataaaagagcgcgtccaaagacatgccagagttacgccgctgggagttcagggcgtgtgaagagtgcttggcactggattgacagagtcgcgctgaggaagtgtgacttggcggagaaggagacggcagtgcggtgagtgatgagacggatgcttcacctggtggagattgcagacgggcgaggaaaagacggagaggacgatagacggatggaaaagtaagagagagagagaggtagagagagaagtagagagatggagagcgatgagacagacagacagagcgtgaaggagagagtgagatttggacagagaatcacagggagacaaggaagagagcgttatggaatcaagcaaaggattttggggtgaggtcaaggcgcgcatgcgcgcaggtgcttattgcaattagacaggtttatgtacagaatatgagcatcatggtaaaattatcgcaagggctatttcaaactacggaggcaggcgatgggtccttaaaaatgctcgggtcggggcatggccatcaccggggttggtggccctggacctggagcctgctggttcatgtattgggtgccgtagggggactgctggtgaggagggcccatcatggggtacccgccctcttgtgctgcctgctgtggatagagcatctgctgcgggtacacattgccactgttggagtaagggttgtactggtcatatcccgaggctgacatgttcgacatggccgacggctgttgcacatggccagttccttgagcgaaataacctccagacgggttggcgttgctggcaacggtgttgtggtcatagccaccggacactgcagactggtagctggcctgggggacatggcctccatttggataggtgttgtatggagacgagacgcctgtggcgtgagctattgcaggggcaggggtggccagacccggtgttggagttgacatggcaggcgcctgatacacattttgcgagaagctacctccgtgagtgatactggttgttgctggcgccatgaccgacgtgccaggagtcgtctgcaccgctggcgttgctggggttcctggggctgttgtagaatgggctcgattgacggacggcgaacctgcctcgatatcgtcgtgtttgggctcctctgtaggattatggccatgctgctcagcacgtcggtattgtgagggtgaaggtccaagttggtaggttcctccaaccttcacctgggctgccttcttatcgcgaactgcgcgctggatggcaaaggtgatcagaattccagcggttgcgatgaagaacaaggccgaaactatgcaaaaggcggttgaggcgaacatggactgacaagcccggagatagttcttgtcgtctgtgctctttcctgagggaagcaccttgcaagaggcgtttgtcattccattggctggcttggcgattcccccgaccgctgccaggacccacatgagaatggcaaagccaacccaggagccttcgatcgcagcgttgagggtccttccagatttctgccgcaagactaggacgagggtggtgatggtcgataagagtgcgaaggcaagtgtggcacaggcgatggcagacacgccttcaggctcgggtgatttggggtatgcggaaaggtataggcagcagcagacgatgacaatgagaccggacacaaatgtcccgatctggaccaggaacagggtccgagatgtgggcgatagattcatttaggcgtaagagatgggtcaagggtcgactgtgtgattggatctgcaggccgttgaggaatgagcgggagtggggtgggatgtgtgcgtgaagagtgaacaggtgaaaagagtgtttgcgtgatgagtgaaagagcgaaagaggtacaaaactgaaatgtgggcgacattcaacttaaaagtcaaggtccaacaggactttctcaattgaaaaatggtctaaataaacacatgccgagtgagaataataacaatggccttgcaagaccccacccacagctgctgaacatgctgccctttgcgctgcaatgtccagtaggctatgtcagcaagggcacacagtgcaccaaccccagattcctctcactgtgcgtttctttggtcctttgcagcagtagcttgtctaaaaataggctctggtctcgcgcgaaagtccttctgccaagcgcacctgcgttgatgctgggctgtggccaggaggccctgcgttcccttgtgccataaactccgcaccagtttcgtcatggaacactaacgctgcaatgacgatttgaggagtcaacctctttaataacacagatgtgtatatgtacaatgcaccggccacggcagcgcgctctgaaaaacaaaagaaagatcctctagtctcgtcactctttcatcatctagacgtgtgttccttggatctcgccttgaagaacaatctgctccacaatggcctgctcatcctccgtgttgaagatcgccgccagatcggcctttgctgggcggactacctttccctcgaagcccttgccggtcactgtctggaagatgtcaaatgctatcaagacacgcaggagaacaaagaacaaacgaatgtgattagagatcgacatcaacggcatttgcccgcagacgataatgacgattcctcgcgctcgaaccctccctaggatatgttgcggccgagtcgtaattaccacgaggaacacgtttatgatattgttgacaacaaacttttgtaagacatacattgaacgacgtcaacgagagcagtcgacggctcattcttatcggcctctgtggcatgcttgacgtggttgcccgtagggccttggtgggacttttgcgcgcggtatttgagagccatgccaggttcggccagcacaaagacatcgggcatgtgctgtccggggtggttgggggccttgtaaacgatcttttccatgatgggctgtgtgtgggggtgtgttgatgtggataagttggaatgggggagggttgttgcagttgatgaggatatggaagaaggtcggtgccaaagtctgggtcttttataggcggcaaagagtttttcttgacgtaatgaacgacttttcaaggaaggcgttctgagacctctttttttttttttcttttttcttctgtaggccggtatccttggagcagtctaatgtctgagcagtataaggagagtcacggctacgcctgtcaaatgtcgctccttttctccccgcatccccaaggcacacaaactgaccacccatcacaacgatcttctacatgtccaccatgagcgcaacaaccaaaattgcagactttgcacaccgcgcctttattctcggtgtcttcagtgccactggtaccgtcatgcgctttgtttcttgaacagtcgtctcaaaacgaacgctgcattgaatctggatcctcggaaaagcgttttaatatttcaatctctttctagtatacattggagtgggaaccgttcagctggtcaacgcccgtatcgaaaagaacaaaatcatgaaggctacctgggatgctgtgagtgggaaaggctcgatctggaatatcgtttgcattgccctcacctagtgtttcttatgatcttgggacttagtcacgcactcactcactcactcactcatatcacggctttctaggaacaaatggcagagctgcgtcgacagggtgaaatggagatggagagacagcgtctggagcagcaggcaaggagacaggtataaggacccaaaagaggacactattcattcgatcgtatagcatcttctacgtagaaagctacacaacaaaattcatcaacacttttcagatcgcctccggttggggaatatgtggctgaacaaggatcggaaacatgctgtgcataatgcagtttggcacatgcacggaggactggatttctattcatgcggctggaatggcttccttttgctcccggatctcccatatacggttcccggcctgaatcgcccgtgcgactagctcaatgtccttgcagtcactcacctccagcgtcgattcgcctccaactttgaatccggattgctcgactctcaaaagatcggtcataagtccaactgtaccgagatgcgaggcgatatcggcaatcagcgtgcgtatatatgtgccagacgaacaatggaccctgatatgaaagaagactccctggggagaagaggggattgcaatgtgattggggtcggctgaggaggtcggctttggcttgaatccatcgtcaaacaatgttgctgttggctgtgcagactctgtggatgatctccctgacaatcccttctcggcgcggaatccaaagtgcttcagcgatggatcaggcgtgatgtcaccgtctggaaacgataatagatcgagatcgtagatctgtacttttctagtgggaatctcccgtggcagcggaatgccctcgcgtgcatagtcgtacaaccgtttcccatccatgcttaaggcagagtatctatcaacataaggaaatcaatacgtcattctgagtgaactcgttactgaacttgcgtaaatgcgaaggctcaactttgtgcgaggtgtgcttacaggggcggggtttgattgatctcacccttgaaagccttcaatgcctggatgacgctgtcccttgtaatatgatctgtcggggcctgatcgacaagcgatccagtgcagtccaaggttgtcgaactaaatcccagacgcgcttccgcgatatacacctaagggcttctgcattcagctttcattgctgtgtaaagtcggcagaaaaaacaatactttctcgctcgtctagaagtctttaccttggatgaggcactcatattatgaagctttttgcaacccgatcccattcctaccactgcccacaagcccgttcgtacccaaaatcgcacaatactgttagggtcgcaccttttggggatgttttcataggaatacgctccttttgcaccatgctcaccaacgatgccccgcgccaagggatcgagtgttcctccgtgaccgatcttgaccaagccgcgtctcgcgcgcttggacccatcgagctccagcacccttttcaccagagggtgttccttattacgcttacagacacgctgaaggtaatcaagaatggaagtcgatgtcacattcgctggtttgttgactgcaaacagtcctgtcaaagccgggggtgtgtgcgatggcacaagtgatgctgcgtgtgcggcgcattgcgttgcctttagtgctgccatggagatggaggatcggaagtctcgaacaccgctgtaaagacatcaagcgagattgtgaccgcctcgctgagattgaaaacggtcatcgcgaagcacgcacctcgcgtgctcgtggagtagccttgtggctattatacggtctgctgagattaagcccattgttctatacatttgttcgaaagacaacatcgccactttgggcaaatatcgcgcttgttattggcgaaacatgtggcatgatggtgcgggtacgagacgaggcatctatccaatataaatagccaagtacgccccacttcgttcttgccctccgataccctgcacaccacagctccttccactacctccccttgcttcaatttcgacagcaccatcacaataatgctcctccgaaatgccttagtctgcatcatgtacgtaacgcttctggccgactttgcgtccacggccgcgatgtataccgaacattccgcggcagtaaagttccgccaagtttccaagacttgcgctgacaagtgtgagaaagcaatcaaaccaagagctgcctgcggtagctcaagcaatcagtatcaatgcgagtacaaaattaatgtgtttgaaaagtgcctgcatcattgtattcggaccattccaccggatatgatctatcaataaattcacgtcccaagttttgggtctgtcgcttcttcatacttatgctcgtcgtacggggcatttcagtcattgcaaacttgatgatgattctgaacacaatgcagaaatgtttgccacgccgagcgcgaggccgtaatctctgaaatatcagtgctcgccataaatattatggaggtaaagcgggtcctcgtagtcgaccttcgcgttcttgatgcttttacaatgctcacgatggcgacagtactgaatgcagttcgtaccaagacgcatacattcgcaaactgtttactcattaatgcgcaagactacgtatcaacagaaccaatggaatccattgcaagcataggaatagccaggaacggctaggacttttaccatgccttcgcatgcacctccattgctcaaaaagtattccaccgcgttttccgcggataagcgacagcgctcacgcgcattgaaagcggttcggaccaattacattaatttccgctcggtctttggctagaaagcggcatcgacgacaatgcagacgagactgcagcgaccaatactaatgatcataaagtggtgaagcaagtgcaatcttctgtctgcccaggcaagacactttatataaagatgacggtttagaaggttcacgacacgcaacccctccgacagcttgatactgatcaaaggaaatcatcgagttatcttcctgtaaaacatgaatctcttgaccatccacgtcacagtggccttcgcaaccttgttgacatccagtttatgtcttgccgcaccgactttttttgatataccctacccaatcagcaccacttgctacgagatgtgcttccacacacgacttcatcagtgcgttcgtgacgggacctatcaaatgtcttgtgtaaacgacatgttcccgcaggtcttgaattgcgcaaagatatgcgatatgcgttataaataaaaccgttactcccgttctttttttcatgtagttgtaaaataaccgcaccaaggcactgtcaaagacatgagggtagcgagataaagctgtcctacgctcacggcctaaaattttattgttgagtgatgtcagaacaactcgaccagagcacaaaaaaaaagagtaaaacccctctagtctcgagagagtgtctctcggaataacccagcattgagcaacaggttgcgcatttcagcaatcgtgtccaccaacgtcgaattaaagaagaagtaatcggaggaaaaaaaatgaagacaaatttgcataccaaggaccgcggacgaattacgccctgataccaagccgggggctgcagtactcagttttcatagcctctcacgcggtttcgctctggactcgtagtacagagtctttggggattcttcacgccgcggtcgccccaaccgcgttaggagctgccaaacgtatcttcaagcacatgtctatcaatgattattcaggtactccgtgaaggaaaccgagggtgattttcgtacggtaacagtctattttcttcttttattgtttctgaggctcccgaggatttggttcaacacttcaacactggcacacgctaaggcaagtcaaacaagctaggaacaagcgttcgagctcagtataattgtcagtacatatctttaagcgactttgtgctttacgcatgcgtagtacagcctgaattgcgcctttgccaattcttatagatgtgcggttcataggacctaccatgaaattgctagaataagcaggtggaaaccatggcaagaataggccccttcctgctcttgaggcgttgcgatgaaggtttttgccggctggcttatgctaacatcgacagagccgaaccatgtttatgcggcagtgtgaacaccgatgaattcaatactgatgcactcgctacggatcatctctcgtcattcgatcgtcgttctggttttcctcttcgttcacacactaaggaacatttagtatccaggcattcttctttttggctctgttctgaactcaccatgccctgtccaactgtcgctagtaatggtcttgctagcgccgttaacggagaaaaacaatatggttctgtagcttgtggaattttctacaggttactgcagttaggtggagtagagtagtgtcagagcgtgcactgcatctaagaaagacttctcggctttgctcgaattagaatataaaggccatagcgtctctctcggaatattagctgaacagcaagccattcattcacgcgtcggaaagaacacccctaatataaacgatctacttcagaacccccaaccaaagcatctcgagaaaacatttcatcgagtcatgaagtcgatttatctctgcatctgcgccacgttctttgtgcttttaatcgcccttcccgcctccaccgtccctttgacgactgcagtgacatatgaggggcttccttatccgcgcaacaagacctgttttgacgattgcgtcaactcaagctttctatcttacgtcgcctgtggacatcacggatcatctcaagcacagcaacacggatcgcttcaaatgcagcagaacgagtccgaggaggtttgcttggcaagaatctggccccagttacgcaactgtactctcacttgtccttctgaagaggttccgtcaagtctgaacattgccgactataacgcgaccacccgctcataagcacagtacagcgaagaaacaaaaggcaaaaacagaatgaggaaaaaaaaacaagtgtccacgcaggcaaccaacattcagaaaactattctattgttttaaacaataaaatggcaggcacttcttcacaaacatctgtcatcatgatggctcagctgagcacatggagatgctggttttgtgcaatgtagttagataaaaacggcagcgatgtctgcgtgatgagggataggccgaggtatgacaggactaatgcttgcgagcacggtccagctagtagatctttttgaatgcaaggtatataccacatcgactatcaaaaatgtgcttccatcgtctccttaacctccttactaaccgaggcatcttggattgacgcattccccttctgtccaattcagactccagcctgcgtgctgattccttctatgaagatggtacatacgcttggggttaaattattactcaatgccatcgctagaagttgcatgagtaatactttcgactccttgcggctcaaaacctctaatcggggatataggcatttaaggaaaggaatgatcgtctcaaacctgtgtctatgtgtctctctacacccgcgcatgacacagctggaacaacccttagagtcttccttgaaggttaacaagctactcgtgcgctcgatatcatatttctctctaaaaaagaaagcctgacactgcaacttccccgctctagtgtggatgtggttttcatgcatcgcgcatactgatcgttatctcgatgcgcttcaacagtgctcaataactcccaataacttgcctctaaataccgtgcgagggatctaaaccccgtctcttggaaccagtgcttttacaagttcagcctcgagtcagattgcaatagagttaggaggaacggttcgccaaatctaaagccatttgagaaggcaccacaggtcatagaaacacagaacgatactcaaattgcgataacgacctggccttcgtagcagctgcagcactggatcgagatgcactaagccgcgtcaaaccgatcatgtctccgatttcattatcactggtggactcctacgttccgactcccccctgtcagactttatggatttacgatgccaaaaagaaatgaatagaggaaggatatagtggactgtatccacaagcattatgaatcatgaatcatggctcagcccaaaacccgaatcgccatgcttgcacatagaacaaagcgagtgttaggaagctgtgttcagtaacgatactactggcaacatgtccatggttttggcttggatgcccttctcaatcttctttggggttgaactttgaccctaacccgtggcctgtcatgtctctgatgacatccttcccgtccgaggtgctgaggggtgcactgtgcatcaaaactgcttgatcgagagccgcatctgtgcggaaagtgggccgtgagagattgtgtcaacccatggcttgctttagtatgatagaaatccgaagcgaatctaccaatctgcccacgaaaatattcacttccgaccattgaccgacaacgaagcaaaagcgaattgtcatccctgatcaccttcccaaagtcgaacctcccctcgcccttgcctggcccaaggaacgcgccttgagaatggggtccctccctacgacggttgcatcaacaatcttcttgatgctcatcgctctcagaggacccaacaatatcgcggccgattttgccagcatagtcattgatagcgcgccagctactctgcctcaagacctgatttgcagctccaactgcacagtgctcaacaacaacacttggaagctctgtcgccctggtgcagaaaatagtctatttccgcccaatatcaacatgtcctgtttcagcgagtgtagcaccatgaacaaccactcatggtctcaatgccgctctctaccgaactcatcgccagagtatcaacattgcaagaatcgcacgcgaatgatgttctttacttgcacgagtcattgttaatcaatggatagtgagctgccgctaagaaggaaaaaaaaaaaaaaaaaggtacctgcttccgaaaccgacctcgcgcttcttgcgattcgagtccactcaacgttgcctcttccaaataaaagtgctacaatgtcgctcttcaagacatcctcgtttatgagagatcatcagacaattacactagaatgctttagcaaacatcggtggcaggtccttgagaaactgctcagatgtgattctttgctgtgaaggtggggaggaagcgcacgatgagggggtggaagacgaggacatgatgtcggaggacggaggcgagaccgacatggtcgaggatgcattcgagagcgatcgctctctcctcgcagggatgaggcgaccctcttgcgcggcagtgcgaccacgctggatccgtcgtgcaaacgctccttcgccgttccgcttgcgctcagcgacaatggccaggatcttggaccgatccatcttcggtggaactattgctgctactgctgctgtttctttttctttgtcttgatgcattggggacgctgtcagagcagagctctggggcaggggcagctccagtggtgacatgggggaaactggactccttggcgatgtcgaggttgaagtttcaggtgaggacgactgaggtgacggcgtttgcattcgcagtggcaacaccgccaggcgcaggggtctgatgggttgagcgcgcagctgaggactctgcctgcgtaatgtaggcggggcgtttgagcagctgctgtgctctgtggaagcgatgattgggattggaagtgagggcagtggtgtgggcgaagatgccaaagatgctgggacagaagaaagcaggaagccctcgttgctcaatctctgaatcaagtcatcctctgccgcctggctttcagcatcctcatcctcgaacgtggaaccgctactgctacactcggactcgctctctgtaaagtcctcctcgtgctcgtcatcattgtccgatgaagattcgtctagactctcgtcacggtagtcccacccgagctcgcgatcatagccattatagtatcccagctggatcagctcatccacattttcaatctcgaggacttcattgtagttcgcccatcgcacagatttggtggctggcggcgttggcagagggcgcgagggctctagtctgctcaagaccttttggcttgagcgtcgttgatccttggttttcgattggatgttttgatgagtttgtgatgaagagaacgtgctttgcagcaaggagcggtgttgctgtggcgagcactgttgtcgttgcatggactcttgttgctgctgtaggtagcgatactggatcataggatcgaggtgcggatgcgtttgctggcgtgttggaaatatggggcgggtttttttcaaaatggatcgtaaacctctcttaggctgctgctgctggtgttctagctgtgtatcgctagccccaaagcgctctcgatgcaccctaccaagactcttgcggctagtgcggctgctgagtgaactgatagagccagcagagccacggcgagacccgaggcttgggcgacgagtgggaagtagttcttgagactcgattttgaaaatgggtcgtctggcgggtatggggatctctgatgcgacggacgtccctgctgtgccgcgagctgctgctaatggtgtgttgttcggtccactctcatctctgtatccgagagactgaccacttttgctgtgtccagaaaagcacccctcctttccgaggctgactcgtttacccttggctatgcagtggtcgccgttgggacgacgatctggaaggaatgtagagtggttgtcgtgcttggtgccactgccagtataattgctgatcgtattgacgacaacacgaaacatcttgctatctacagtcattgggattactatggggaagtgctaaacgaagccggatgaaaagttgccagatatgggactcaaagagaaggttgagtggtagaaaggaaaggaggcaatggtctggaagaggatgttgcggtaagaagggttgtggatagttcgttaaaagtagataagaggataatggctgtggtgtcgaccagaaagggtggtaggtgctggtttaagatggcgtcttgttttttttgtacaaacggagagaagggatttcgtcaaggaagtgagcaagcacatagggtggagaactggctccgacgacccctacattatatacgcgttcatgtccaaagcagctgtactgaatggtcctctcataatgatgttatcgccatttcagggctgtgagggatcgaaaagggggcgagatagcaggtgcgacagaacaacaccgttcatccgttctcggatcattcttaccactgtgcccaaggtggtcagacgaggaccacaatgcctgtcttgggctcgggcacaagactgccatgacccacaccaccgacgccgcgcctaccagcggacgatgtttttttaatgtaatgtggtttttttttttcgaacacacatttttctggctctgtatactactacatcctcgtgctgaatgcatagtttcgctacataaagtactaagattggttgcccttgaacaaaacggcatgagttcactagagtcacagagggtggcagcaatagcagctcagagggtggcacactgcagttgatagcatcgatgtatgctgacacctccgcgccagatcccatttttcgtcactttgcgcttgatcgctaaagaaggcacatggattgataccgactgcggactgttcactgactgctcttggagctatagtatgagaatcaatgcccatgggtccagtggacattacaccacgccgacgaaagagaacatactggaaagatgaagaaatattcccctgagtagagactaacagcacactcactgatcaggggagggcaaatgcaggggtggccagcctgtcagcatcattcttttatcctctgcatgttgggtcatggatagacatgggggggagggattcattcacgccccgtcagtggcgaagcgagctctccttggaagactatcaggcacacgacgcgtccagcgaggactggatgaggaagccagctgcttgcgtcattctgctttcggagcgatccgactttattgtcacaaagtacgttggcaaggcttcgccctgtccattcatgaagcttcctaataccaccaaaatctccagtagatgaccagcaagaatacaaagaggatgatgacaggcgggccatacttgcggtacaatgcctgtaggttcacatctctggccgtcttgcggtagcgaagcgagtcccggagcaacagctctgatttgccctgtagattgtctaatgtttcccctctaattccagatattgtataatgttacagccttagtgagagttggtagtaacagagtgcgcaaagaaaaaggagattccatgtgcagaagtcacatgtagaccaaaacactgctctcgtacctgtataacaaatcctccatgttcctggtcatgatcttggtcacatcctgcagatcctcgtgcaactttgtcaggtttgactgtgtcctggtatcttgatacaatcgctttgtgttttgcatgaatgtatctatgcaagcaaacgagtttttgttagtcagattagtcagactccaaaagaatggtggcctccacaggttgcaatgaatcgcggcgagaaaattgtttaaattaccgaatcgggcaaaagcataaggtcgaaggccaggtcggtcgatctcgttgccgtagctcataaagaactcctttgaaaggtcatcgaggtatgtgaaggccagtttgcgtgggtagttgcgttcgcatatgcacaagtagaccacgccatggtcaatgatgtagctatgcaagggataaagtgacagatgcctccgggtgttagaatgtaggtcggctcactttagccgcaggccaaagcagcgagtgtttttggtctgtcctcggagaaaaggtattgtgttgtctccaaaagtcgcctattcatgtccatccctgcaagagatcatccggttgatgcaactacagagtccatcatcgaagctacagccatggctcctggccgagtatcatcgttccaggtgcgtgccatgtcctcgtgctttgacctatcaaatcgtgccgcgacggattaaaatttcacatactggaatacatagctgccagactcgatcgagcatcgcctctcggaattcatattcagtttgcggaagatgagcttggcctgcgacttgtactccttgagctccatctctacctaacaggcgtttgcaggaagataagttacaagggccgttgacaagtgacagggaattcattcctctgcggaaaaaaaagaacacgggcatttcaagttgccgcgcactgaagtacctgctcgtcatcaatggaggcagccaagggcagcgctgaagttgaaagagaggacacaatggctctatgttaaaggacgctgtgggcgtttcaagcaagttcgaccgaggacacgctcttgcctgccaagtaacgacggtttaccatccgaaacgcgtgcaatcatggtagtcttcaccatctttgtctatgtctgtctgggttgactgatggaagtgaacttgaggacgttgctgtcgaatggaaagaccgagcactccagcgtgggcagaatgatgtggagcgaaaacgagttgaggaactgtgaacatgtgatcttgatgcgctctttcacgactgcaagcagtacttaagggtaccaaaaggcatactcgttgcacacgcggtaagcatactacacctttgaattgtcgcgagcaatcgatatgaactgcaacgacagtgtttagcggtttctttgcgtataggattcaacataccaagaacgacaatgccctccttttctgtctttatttttggagcatgttcaaaaagtacatgatccgcttcgactcaaaaaagaacgcatttaagccttgatggcgtacttgcggagagggaagtgggtctccttcttctgctgcttgacggtcttaagagcagcctcgttcttggtaagacggcggcggatagcacgggtcttcttgacgcggaggtccaaggggaggaagttcttcttctggtagaagaggcggagctgagcacgctgggtctgggtgatgacagtcatgacacgggcaatggacttgcggacagcagagctggaacaaaaaaaaaagagaaagtaacgcagggttagcgatgtgttgctagaaagaaagaaggcaaaaaaaagggtcggctgtgctgaaatctctgccgtccaccacaattatttcaacgcctgagcattttccaggggatcaactccaactacgaactattgtcggtacggaaagtcggtgcaagcttgcactatggtagagggagttgcagcgaaccactattcctgagtatatatgcgcccaagtccatctgcgtgcaggatcccattgcgaagatgggtgtaaaagcggtacaactcttccgtttgacacctgatgactgtccgctcgtcgagtcctgacacactgaacgacaatgataattcttgaagtgtctaaccgcaccggtatcttgatagaaagacttacatcttggtcagcttgccagcggaaccaccggcaatcttctggaccttgaggctggcaagctcctgcttgagctcctcgagctgcttggtgagctcggccttgttcttggtgcgcaattcgtaagccttgacagcagcctgtttttgagagagtggagtgaaatcggtcagatgctagtccatttgagctccaggtgggatgtacgaaggagtggagcggaatgaatgatcctgaatcatggatcctgcttggatcctgtcgagccatccttggttccacacaagatttactaccaatgccgtgttgcgaacgtgcttggcaatcctactttgccaaactgcacggatcctgcactgtccgtgcctacttcagactgatcctttgtgttgggctgaagttaactacttggtctcttgtgcagaatcaacaggcaagagccagaagtcatcgaaagctgcccgatccatcaaaacgccttgcccagtcgccaggtgcaaaggggtgccgtcaatgccagggccagagactatgttttcttaatctgcctgttggcgttgcttgccgagggctccaaagctacagcggcaggtaggtgagcagatcacatccatgaatcccggcgccctcgtgaaatggagatgacgatcctgacgatgggggttattgattttttcttcccgagatcagagttcccttccgtgtgagtgttgatggatgcgtgggtgcgcatgctccacgggcgcaatggatggttgggtgcgtcgcgatgctgtatcgatggatttgcggctgttggggtatgggtgcaatcacatgacaccgtaaccgaccatttttgagaaaattgagagaaaggaggttccaaccggtgcacactgcccctgctgaaatacagcagtggtcggcagtcacaccttcgtttttttgctcaagcaaacaagtgttgcaactgtgttcccttgcattcaagcaccacacacacacgaggcaacatccacattgcacaaaagagaaaatgggtgcaaagacaaaagagaactcctcaaaacgagctcctgcctcaagtaagtggcattaaggaatcagtccaagtgtcgctgctgcagtatgatgagcgctccagctaatagttcctcttttactgctctttgtttagacgagcaaaaggtattgaccgcagatcaaagaaagcgataacctcgcatagattacagggatgttgacaggagaactgacgtggaaaagtactttgaattggcgatctaggaccatgcggcccctgcgcagaaacggacaaaggtatcaaattgcctacctgttctcctcaaaaaccaacacacatggaatgtatcttgtgatcttctctggtgctaacagacatgaatctcctacctttagaaatcagagagcgagattccgtcgtcaatagcactgtcacagccgatctttgaagatgtcgatatggaagatcaggaagatatgacatcaattcaggagcggccagaaggcgacgatgaagacaatgacatggaaatgcagggcgatcgtgagagcagcgacgaagggtcagacgtagaagatgacgaagatcaagagttgagaacgaataacgccactacaccaaaggtaggaaaaactatgctgtgtcctggctaaagttgcgagagagctgactgtggaccggacgtctctaacgtcttccgtctcatccattagaaggaagcgcacacatcagatcgcgtccaaaaggtcatgacaaacccagagatcgaagcagcattccacgaccaatacatgacccagatcacgcaggctttcggagatgagctcaacacactacgtgaggtaggctgataccgggttgtcgatggttatgtgcaatatgtttgaatgtgtgctcacaaaccgggagagcaaagtccaaagtcttgcctatactgaccccttgactgggtattcctattgatgggatgactagaccgactccttagaagacagccatctggaacttttaatcgactctttgaggcagacaggacacatctaccgggtgttggagaaggaactgtgggtcgccggagaccagtgactgaatgaaacaaataaagtttaaaaatcctttttcccgcacagtccacttttttttttcctccattccattcacagacattctttcccctccactggcaatggcaatggacatccatggagaacaaacaccgcttatatttagcaatcgcgaaaacggcagcagtaaccatcctcgcagaaaccgggacagcttctactcgacccagcgaagggacagcctcccaagcgcaaccagcacgttctacggcggcaatgaaacttctctggatcgccatgatcttatcccacagccacaacgacaaagacagcgacagccccaaccccagccccagcttttgcaccagaacttggacagggcgcaccgccaggagcaggcacacactatcactactaggcactggattgtcttgcttctggcctgtttactcctctttggcaattattactgctacgacataccagcggtaaacgtcaaactctgttctcaaaacatattgttactgggcaaaccctgtaggcattgcacccttacttcgtctgactcttcatgctggaactgtttaggcgctgaatgtccaactcagggattggttggagacggactatgccacacatcaataccacctcaatctcctctactccgtgtactctctgccaaacatcatcctcccgctctttggcggagtgttgatcgatcggctctcggcctcaaggatgttaatcctcttcagcatctgcatctgtatgggacaatgggcctttgcgatgggcgtgtctttaaagtcaatctggatcatggttctaggccgctttatctttgggataggaggcgagtgcctcgaggtcgctcaagccaagataaccacggattggttcaaatcccgatggctaggctttgctctgggattgaacctttcgtcggccaggatcgcgactgcaatgaacgacaatgtatcacccttaattgagagtggaggtggaggtgtcgtcggcgccagttgggctggcttcgggatatgtgtgatgtccctcctatgcggctgggggcttgcatatctcgacagcagcgactcgaggaaacaggcgggagtaagactggatgcaagggatcggaggaaggactcgatggttcggtcaagaactgagaatatcgtaggaagacaagccatcaatgtctcgtccgattctaccatgaccatgtcctccgaggctttggaggaggaagaggaggtcgagaaggagaacgagatggctgaggatgatgagatgcgcttctcagagatcttgactctgcagccaaacttttggatactgtcgttgtgttgcatatcgctgtacggtatgtgtgaattcgatgtctgcagctacccgaacgctatcagcatcacatagagagttgcctctaatgcattgctaatgacatttttgcattctttgacttttaggggctgtcgtaccattcaatcacatctcttcagattgtatgctccttgtttttctcaagagttgacgcgtgatcttttcgtgcaccgtgcgacaccacatctaacgcgtgtttctgacctttgggcaatgtctagtcctccaaaaaaagtggcacatgagtccaacaaaggcagggacaataatggtaagcactgcatagggcaggatttaccaactgcttcgcaagggcatccatgattcattttcatgctctttccagtccatcccagatatagtctcgtcggttgggtctcctgtctgtggttacctagtggatcgctttggaaatcgcgctcgttatataccgctttcggcggtattcatcatctgcgcgcatggcctatttggctttactgtgatttcgcccatagtcgccatggtcattctaggactggcgtattctctctttgcctccgtcctctggccatgcatccctttcctggtagaggatcaccagctcggaactgcgtacggtctcgtcacgatcgctctcaacatttccttgaccttctttccaatgatcgtggcctcaatccttcacggcaccggcgggtcttttatgcatgtgttaggcctattcatcgcgctaggaatggttggtctttttctctctggtcttttcaatgtactggattatcgtcaagggaaatatattcagctcatcgagcaagcaccttcatctgaggctcagtacccggaggacgagtgttatagtcagcgcactcggcgggatctttcgcaacaacagcgggtccagcggcaagaccactacaatcctcgagagcctggctttgagtatcgacgccacaggcggttttccgaggatctgctgcagcaagaggatccagatattgagaatgtgcaggacatggttacgacccgaccggtgggcgagggcattatcaccatcattccacaccggagaaggcactccatggcagggtttgcaggttatatggagcgcacgcgtctaggaacctatgcgcatcatgcgcgtgttgcgcctgcactcaatagcattcccggcactatgcctcatgagccgtccccgtacctcgcgtcaaggccgcgctttcccgggcgtcattgatcgtgtacttttatcccaaatttatttcagcaagtacacgccttacactaaatttagtatgcgaggtgtctctaccctcaagctgtggcgtatgcggagaccctgcgtgtgaatcagcccatttcttgaattgatcgcatcatttgaaaatttgcaactcttttccgctccaacccccgtatcaatcatcatcccagatactcgctaccatccttttgagcaccatgagattcgccaccctctcctcgcttcttgccttgacgctgatctcctcgtccggcctcagtgccgctgtccaggctgattcttcgagctccactaaaacccctgttgacctcagtgagtgcgcaatcctccttatacgaacgttcaaggagtgaatctcgttttaacggtccacttttctctccccactccttctgtccctatctgtcaatctctcgctcgttaatgtgatgatacatagccctgtttgtgatgtcaaggtgcccagacgcacggacctgcgaggatacgttttcacacgtctgtaggtcctggcaagcgtgagaacgagctggcaagaggtgcgttcatttggattgacagagccaactatcccatctcatgtccattttttcttttctttcttttcgtttttgcttttattcttgtttttctcgatagtggaaacaaaaaacctcccggccgtcaacctttcgctctcctactttggaaaggtcatcaatcgctcgggcaaggtctcggtggagtgtatgcatggcgcgctggaatgtgaggggaacaagcagcagctgtgcttcagaaagttctttcctgatcgcgagaagtggttcgcgtatgtgttgaagatgaacgcgcagcccagcagggttggcgacgtcgcttatgcccgcgaggttggagaggcaactgtcgggaaaagcgcactactggacaacgtggaggagtgtgcgggtggccaggagggccttgacctgttgattgcgtctgtcaagtacacggaaagccaaggtgccaagtaagtactgtcgtttgcttgctccaaaccgagaaaaaaaaagaaaaaagaaaaaagaaaaaaaatgtctcgcggttattcatgtacgagggcttttttttttcttcttttgcatcgatagggcgagctgcacggtcttcctcaacaacaagaagcgctgcgtggtcgacgggggtgtttggcgagagtgtcccgggggctcgacggtgcccgactttgtgaggagcatcgaggaggcctcgaccccgctgcagcaggcgaagcgccactggatccgcctgaactggtagcacgtgcaaatataggtattgaatatggtgcagatgtacgtactgtagcacacccactaaacctttgcgcattgccctgtttttgttggtcctgacaaaatgggcctacacattcatctcaatgccacaaataagtaaaaggaaaaaaactacaaccaagtccttgctcgtgcgcgggaagcgaagagggtacgtcgtgcttgggaagagctagataagattgctttagatgttcaagtcggctaggaacggcaggagaatgaggaggggcagaggaggaggcgcgtctaaaagaatgcgagaaactggagcggcgactgaagagactgaggcaggatatcaaggacgctcaacgttataaacgacgcgtggcgccatatggtcaccgttcagatcgcagcgacacctatcgacggagcacagggaagcgactcacggaggaggagcagcgagcagtgcgtcattgtttcgagatgtgcaatcaagagaatcgtcaagcaagaacagtctccacggcggcccctgcagagcgaacggcccattatcttggggtagccactaaaaccgtcaaagccgttttgagtggaataaatcaccagtgactctaaaaaaactgcacaagagtttgagagtcttctaggaggatactcatcaaattccgtcaagagagactatccgcaagcttcttcaccagatgggcgtcaagtacgaccgagcagacaagaccaggaactacacggagacccccgacatcaaaatgaaaaagcgacgccgatatctccaagaacgatactcagccaagtacaaggacgcacttttcatatggctggatgagtcctacatacatcatcatcatgtccacaacaaggttggtgtatgtggaggttacccagcgcacatctacagttctatcacatggtcactcaatcacaccgttgcagtaatggtttagtgacggaatgacggtacttcgtaagaacaagggtagacgttggtgcatcatttacgctgggagcgagtacggatggatgggggacccttgggtctgggaggccgacagtcgttcagcggattatcatgaaaacatgaatgcttcaatgctcgagaagtacatgaaggcgttgtgtcggtggtgcaggaccaagtatcccgagaagaaggtcgtattctgtatggacaatgcccaaataccaccgacgcgagtaccaggatccttcccagcaagttgatatagagactgagcacaccgcaactgttgacgattacttacgcgtcacgcgaagtagacgcaaagacaagctcgaaaataacgcgcctcagaaatcgctttcacaactcaacaaagactggatattttttgattaaagttttttgtgggcgactatggcttgtagggcttttgtacagcgttttttgaaagaaagaaaaaaaaccccattctgtcccattccatggacacgcgcttcctcaggcccacacagtctgatccatccctgttgttctgatttctcggtctgtgcgcggcgacactgcccctcaggaaacagaaggccagccgggcgacgctgccatggcccatcccaccgacgacgactttgatttcggcgacctcgaggacctggagctggacatggaggagcgggccatgctggcaggggcggctgtgcacaccaggaccgcctcctccaccaccagcacgcggccacccaccaccagcaccaacaccagcgctgcagcggccacggcggccgtgcacgacgagtttgatgactttggcggcctcgaagacgtcttgctgaatgacgatctcttgacggaagcagctgtgccgacaactgccactcgctcgtccttctttcaggctccaaagcaaagtgcagccaaccaggcatcgcaacgacaacagcaacaacaacgacaacaacaacaacaacaacaacaacaccgacaggcacgcccgatggtcccgcctgcccaaccgaccaagctgttccccatatttggtggcaacagccatccaccaccgactcgcgcccccgccccagctgcgcccgcctggagtgcccccgcgccatcacgaagcgtgatccctcgctccgatccctcgaacgactttgcgacagacatcttcaggagcccggagacccctcagcagacggctgcagcacctacgcatcacgaaatcgacaagaaggaagcattaacgtggcagtaccccatcaactatcccaggcgcgactatcagttcaatatcatccgacgggcgcttttcgtcaacaccttggtctcgctgcctacagggctcggaaagaccttcattgctgctgtcgtcatgctcaacttctttcgctggttccctaaatccaaaatcatatttatggccccaacgcgacccttggtcaatcagcagatcgaggcgtgcttcaacatctgcgggatcccacagcaggacacggtcgagctgactggccatcaaaatgcggatgtgagaaaggacatgtggatcaggaagcgtgtcgtcttctgtaccccacaggtgctacagaacgatctcaagtccggaatttgcccagcggaggatatcgtgtgtctcgtggtcgatgaggcccatcgtgcgacgggccggtatgcttacgccgaggtcatccggttactggaacccctcaaccgtgatatccggataatggccctgacagcgacgcccggaggggacatcagaaccgtgcagcaggtggttcagaatttgaaaatcgccaagattgagctgcggaccgaggactccatggatttgcagcagttcgtcttcaagcgaaccgtgcaggaaatggttgttccatgcggtcgtgaacttggagagatcagggacaagtttgttaggatgatgaaacccttcctggaccgactggcaaaacagggcgttctgagaaccaccgatccagggcaattgtcacggttcgctgtcttgcagggcaaagagtcctacgtacgggagcatccacaacattcgggaaccaagagtttcatcctgaaacagatcagcatttgtatgggtcttgtccacgcttacgagttgctgacaattcacggaattcgccctttcttctccaacatggacccgtatgcgaatagtcaacaagacgcaggcaagccttcgggcggcgctcgaggaggtacaggaagcaaacggaggaataacgaggacgaatgggacaaggacgacgataacaaaccctcgcctgctcggaaggcgatggaggaaatcccagactttatgcgcatgatggacagcatccggagcaagatgaagctgaccagctttgtcagccacccgaaactggagcgattagttggggtggtcgtccagcactttatagaccatcaggacgagagcgacgctttggctagggcccagtctcttgagagagcggactctaatcaatcgtcatcgatcacgactgccgggcctggagcgacgccacagacccgagtcatgattttcgcaaactaccgagaatctgttgaggagatcagtcgtgtgttggactctcaccgccctctgatcaaggttcagagctttattgggcagtcgactgcaaaaggcaagaagggcatcactcaaaaagaacagcaaaaggtatgtatctgtcatagtagaagtcctacctttgaagatcgccctgtttttgacccttgccgtgttcctcctttattcttttaggttgttgcagattttcaaaagggcgaacacaatgttctcgtggcaacgtctatcggagaagagggtctggacataggagatgtggacctgatcgtgtgctatgatagccattcctcacctatccgtatggtaagaaaagccgagggcctctctttttttatccgttgatgtggctgtttcataaggcttattcaaaacgcattattgcactgcacatggtagctgcaacgaatgggacgcaccggccgaaaacgtaaaggcaagatttgccttttacttgccgagggtcaagaggagcaaaaatatcgccgctcccagacgtcctataaaactgttcagcgggccatcgctcagggtcaaaacatccaatactaccctcattcaccccggatccttcctccaggtccgcctccagcctgcgatctcgtccacgtccaagtgccgacctacgtcactccagcgacagggcgaaaacgccggaaactcgacgatgggacgccagccaaggcagttaatcagagtgcctttctggatcaagaagaactggcgcgtttccagcaccggtatttgatacccaaacgaaacattcgcctcatcacgtttcagaccgcgtgcgcgtcaatgctgggttccaagaggaggtctgtcatggccccagataagaccgttcacgttgggcactcgacacggacgactaaatttatatccacggtgaatcagattgcaaaggcgaggcttgatcagtccttagcacccccgactgaaaacacgattgaaaaggatccttactcaaagcgaatgatggcgctcctgaagcaagcggaagagttggaagtggactcggaagaccagtcctcggatgcagcaccaatctcccatcgtggccgaccgtggatgatgccaagcgacgacgaagatgacatcagcgacagccagccagaacctcctggcggcccagacaacagcattcttgataaggatctacctaaaagaaagattcgtccaaagcccaagaggaagaatccagcggcgaacccaacagttgctccagtctatgtcatttccgcgcaaccagctgtagcaatatcgccgtcgccgtcgccgtcgcctctaaaatcacgcacttccaagtcctttttccagaccatttcggacgatgaggtcgatatggagataatgggtggtctaggaaagggtttcagccagaactaccgtcagtcatcgccagactttgatgactatatgcctgtagaactggcatatcaggatgaattgtggcgaccgcaggttagacggaaagggttcagctttcaggaatcgtcaacaccgccgacgttatggttcaaggctgaagaacacgaggacgagtttcgcgggacgggtcaggatgagtactcaaccacggacggagagatccaggcgttcaccgttgcagcgcttcctcctgttcctgaacctggaatatggtacgtacctaataccaagaacgcgtacaacagcggcaaggacagtgtggcctccactcgatcaagtccgggctcgaaggtgcacgaggacaagatccttttggtcattgacagttcggaggacgagctggacaaggaggaaccggccatcttcaaagcgccagccttggcagatcgtgcgacgccgtatacccatcaggctggctcgtctgcatcggcaacgccttcgttgagcaacgcaggatttgtgtctgccagaactcttgcgcctggtctgggaagtggcgcccaagctgtgggcaacggcagggacagaggaatggataagggcaagggcaaagccaaggcagaggactttattatggaggatgacaatgatgactacgaggcattttttgaggactttgcttgggactgagcactgttttttatttgtacaacagtaaaaacatgtatattaccaacattctttcagaaatgcttgttgagagcgtgtattctgtgtgagggaggaatagtcaagacagaatgatatgtgggcggacctactcaaaacacgtatgtctgtttgatcccaaattcgacacctggtcggatatcctttacgccagcaacgacctccgcatagtcggtcgcgacctgcgttgtgatgtaccggatgtgaagggactgcagatgtggccagaatgtcctatccttgcgccttccgcatttctcattccctggagaatccccgtcgtcatcggaaccagcgtctttgttcttgtccgcgatgaacagcatgacatgagaatggttctctttcctcaagaactcaaagtccgtcgcgtgcacggtgccaaagatcgaatgcgacttgatatcgagcgtctccaagcatcgcagtcctcgcaacatcaagaactcgttttcccatcgctctgctggcagcacctctgcagtttcggactcgaccgagaccacttgcgtcgctcggggtttggcgtggcctcttgacttttgggccgacttctttgggaactggcgcaaaggtgctacctgatatttgagttggccgaccctgaaggcgtcgatagtgatggacagcgaagtcagattcctcaaaaggtggtgaatctcaacataccgagtgaacgtgccaaagctgttgacgaaagcgccgaaatccatcgccatcgtgcgcaggtctcgacattgccagtcatccggaatggataaccggccgtgctgccatccctgaaagcgctcaagtgctctctggcgcagctcccgcctttcctcacgctcctgtcgctttcgacctcggttgtggttgttgaacgctttgcgaggcgtggaagtcgcatccttgggtatctcaagtgcttctgtagatcggaagacgaacctggcggcgatcaaatgcagcaggttgggcatcagacatagcaggcgatgcagggacagagcggccgttgcgaaattgattgtgggcaggatctcgagaacagtgacatttttgaggtagaagcggacgtccaagctttggagatggtggtacatgttccagatgcaggtggtggtcatgaatcgtccaagagccttgtttcgatgcatcctacccagagctgccttctcatcgtccctactggtagccagatgaaagaggtgataccactcgacctttggacaacaattctgcagatggttccagagcctctcctcgtcgatggggaggtgcttgttcacggacaattcgggcacccagatctttgcgttaatctcatgaagcttgaagacacggaggtcggggcaggttgcgatgacgcgctccaatactcgctgcttcacgataacattgtcgatctcaaagacccgaagtcggtatcgatgagggtatgcctttggcgggataacaacagggggcttccttggaaagtgggccgtctcgggattgatgactggcacgggtttctctgggatcagatcctcgtcgtcaccagagaggagctgcgcgatctggtactttttgcacaccacctttagttcttggaggctaaggctcctgtccagaagcttgaacagggggatgtgtgtggattggacatgaagatgaagcgactgtaaaaagtggaactggtgcaagattctggggatggaaatctcataggtcatttgcggtcctttgagcaccaatcgacggatataatgaagcagacatttgggcgaggctgggtcagccgtttgatcctcgtttgaagctgataagggagcagtgatggccgtcttgaaccgatcccacgaaatgctgcccggttggtccagcgataccctgtagcgcggaaggagagaccccgtcaggctgctataggagcactcaagggtaaccaggttcggcatttgctccaggagccggttctctcgctccgccgtagcgttattccaaacacccacgcgctggataaatcgtctgctggcgttgctccactccttgcagaccaggctcaccgcacagcgcagagttgcttggctcagatgtgagcacacgagctcaaggacctcgatcgggaacgcgtagtgctttcttgacgtcccaagtatgggcagcaaaaccttggtttcggaatgctgcttcggtttgctggctttggacctgtgccgctgccgtggctccagatgaatatcgtcgggatcgtaaaaagcttcttcgaaggcaaggtcttctggagaagagccatatgcgtcggagatagaggacgaatcatcatacatggcgtcaaaggtgttgtggatatggcgattgagatgctcgtcttcaactgcagcagtgtcggatctgaacgaaggcattgaacggtcgtggtacaaaggtgtaataaagagcgaagagcgggatatatctttacaagtgcgagtagagggagtggagtcggcgggttgcaagggaactgctaacgagggactgaaaaaaagggtaaaaagcacaccatatcttatatcccacttcgtgtagagggtcagtgcgaaaaaaaatttgttgccgcagccagctcagggccgcagtccgtgtttggtcgttgccacttagtaactcttaacggataaacacacactctctgcacatctaactgaggatgaagtatatgccgaatacgactagcctgaacttttcacgccgcataaggagagaactccaatggccgttgtacttgttggtgctatgagactgttcccccgaacgtatacattcatgcttatgacttgacatcgacagtaatcacatgaagtacttgcagtaggaccagcataccgcgatccagcggaagacgatcattaccgagcaaaaactgctcacgcagaacaagcccaagtatgactatcgtgtttatcagacgctgagaaaagtaaaagggtatgggcaaaaaaaaaaaaaaaaaaagctgaacatcttgcagacgcctcgtcccagatctattcgacctattactccatcgaatccactcgcaattgacaactaccgcacctacaactggtgagccgaaatgagatgcgcaagccataaggcataaactgcaaaatcgcaccgcgtctgcatctaactgacgtcaagttagcaatcgggagtgcttttttcttgttggagttcatgaaggagcctttggacgagatcgagtatctcgaagagttgagggtctctctggaaatcctcactgaatccttttcctttcgctctcttggctaaccaaggggttcattctttttattgcgactctgtatcgctgatcagacgactcgcttgaagatctcgatgaaggtcgacgcatcctgaccaccggatagcaggtatgtgttctgaaccacaatggcaggcacaccttgaagttgaatgtcttgttttgcaactcgtatctcctccttgacctcgtccagcccctcttgactgtccagcaccctctccatctctgcaatctgctgctgaacttcgctctcttccatatggaatccttccagggcagcgatttgtctcagtactttgcgtccacactccttcagtgttggcacatcaccgcactcgcctcgctcaaaatgactcttgaacaattcctcgaccatcaagtcctcgatcaaattgtccatatcatccatctctgtctcctcagactctggttcatctccaatgactacttctgctcttgctgctgctgctgcgctgatagacttgcgtttccaggacggtcccattttttctcgtgcaaagcggatcaggcgatgagaatccatggtgttgcaatacaaactctgatccgagtacaagaactcgatcccctcgatccttcctgcaaccagtatacgctcctggacctgcgctgcacgctcggagccgaatttccgctgtagcaatttgcttctgagcacggggagttggggtgcttgcggatccagttgataaggatgccagcgaatgtcaaagcggattttgtttggagtctgggactggaagatgtgcatggccttttcgaggcgcctcttggtgatatagcaccatgggcaggttgtgtccgagtagatatccatgcggatcgactgtgggtttgctgctgcgctggtggtatgggcggatgtgggttctgctgcggtgaggttgacaggctgtgtgctggatgagatggatccgcagccttcaaagggtctgctggtaggttctccagtcatggtggacgggcgggctgtgtatgagtggaacaagagcgtgaataggtggcgatgtgcgtgggggatgtgtgctgaaaagggtgagggactctgggaggggaaaaagagaaaattaaaaaagtgagacgaaggaaggaaacgaaaacaaagagaaagaagagagcgaacgacgagagacaaggctttgcaggcaatcgcagataaaaaaaaaggagagcgatggaagaagggacgagcaagagcgagtgagggtgcgatacagcagcgggcggcgtttttttgccgtgttgtgttgtggctctcgattgctctgccccacccgttctcgccatctgcgaggggtgcagggttcttgcagccatgtggaaatcactgcgcacggcgaattgcgcgaacacaaaaaaaaaaacacgaatgaaaaaaaaaaaagttttcatgcacgtgagatacgaccaattgaccttatttacttcacggcgcccgtctttttcgtcaatccgcattcaccacggtccccattgctcattgccctagcccccgtctccttccgctctctttctcgcacctgccactaccgctgtcccgcacgcgcgctctctcgctcgctctctctctcttctccaggtaaaggccgagagtgagcatgcctttctccgccgcgcattgtgatgcaacagaaaacttaatgtggtttctgcaaacaataggacacagaccaggcaacgccgcgtgtttatccgaaaggggctcactcacccgtctgcacacaatcagtcctgtcaccacgtttctctccagcttccccagttgcaagaggacaaagtacgcaagagaatgctctgcagacaatatcgccctatcgtggagcgatccaccactctgatcgcctctcccggaacgcggcggcatatctccacaccagcagccattatcatcgcgctttcatcgccagcctaccgaacgtctgttcgtgccgcgctgcgcgtccagagcaattgcagtcatcatgcgtctgccatccttcaagtttcgcaccatcgcgcgtacaccaccaattctattccacagcgctcagagcaaccctccggactccggatcccttactacaccacagaagaactcgaagccatgaccgtccctgatctgcgtacacttctcaaagaccatggactcaaggtcagcggtcgcaaggccgaccttgtcgatcgcgttctcaagtatgttcatcaacatcacggtgccaagaaggttgcattggggtcccatcgcacccctgctcagatcgagcatcgctccggatctggatcgaactcggtttcggcttcagctcaaagtgaaatggagaaatccgcggccgcccagagagcgactgcagagcagcagcagcgactgagggaacttcaggagcaggagaggcaactcctcgagcagcaggccaaagaactgaagcttagggagcagaaggaacgagaggcgttgcatctggagcagcaagagaagaaccgtttgttcgaggagcaacaacacagggcgaagcagatcagagagcagcaagagaaggaagcgcgactcaaggagcagcaagagagggaagcgcgactcaaggagcagcaagagaaggaagcgcgtctcaaggagcaggaagagaaggaagcgcgactcaaggagcagcaagagaaggaagcgcgactcaaggagcagcaagagaaggaaacgcgactcaaggagcagcaagagaaggaagcgcgactcaaggagcagcaagagaaggaagcgcgactcaaggagcagcaagaaaatgaaacgcgacttcgagagcagcaagaaaatgaaacgcgacttcgagagcagcaagagaaggaaacgcgacttcgagagcagcaagcgaaggagcttcggttgaaggagcaacaagagaaagagattcgattgaaagagcaacaagagaaagagattcgattgaaggaacagaacgtgaaagagcagcaggcgaaggagcaacaggaaaaagaactccaaaccaaagctcaaaaggcccaagagtcttttcgcaagcagcaactccaacagcaacaacagcaacaacagcaacaacagcaacaacagcaacaacagcaacaacagcatcagcaggaaggagcacagtcgaacactaatagccaaaaggcagacacaaaggaatccaccggcaataaggacgagtgggtcaaggagaagattcctttgcgcaccaaggccgcgagcgcagttctgggactcggtattgttgcgtggttcctcgctggcaagcgcaatcgccgaggcacactggacagtgaggctcaggaacccagcgtgcgactgaaggaggaaaaggaagggcaataaggaatagagacgtagataacaaagcatccacaaaagtaatcatcaccatcccactgcattatgaatgacaccaatagaagcgatcaattttgatttaagagatgctgatttcacaagtgaggttaaggaggcgcgctgggtaaatgttgtgcaagtcaagtcgtcaggaggaggcgcaagagaactggacaaaaggaggcagagacgagaagcgttgcgttcaactcgacctgtcactcccaattattctcttgagaatgtggagccgtcatccatcgatacttgcttgatacccattttgcccacctctcaccccacccgtagaacaccctttttatttatccagagagatgtttgtatacaagggcccatgaagaggtataaaaagaaaacgatatagaatgagagagggaaaaaaagtatgaactctactgaagaatacacaaacgcgattaaaaggacgaaagaaagaataaaagaaagtataaagggaaaaagaaaacttggaggggagatttttacaatgcatttgccaccgcaactgcgtacgcgccggaatggctgatcgagaccttgatctccttgacaccggccttggctgccgcatcctgagccgcacccgagaacaccaccgagggtgcaccgctctctgccatcacaatctcaatctcgctcaatccggcaccagcaccctgggtccacaccttctcagtgtcgagcgagaacgacgaaacggccttgaccacggcctccttggctgaccaacgaccagcgaagctggcctggggatcgggtcggctcaagcagtagtcaatctcctgctgcgtaaagttgcgctccaggaacgtgtcgttctcaatgttgatcgcagagaccatctccacgtccacaccgactccgcgcgaggaggacgatgtcacgcctaatgactcttgagcagacgtctccagaatcgcgcgcgtcatatcgacgtcaatcttgtcagactcgggcaccaggtgcttggcattgaacgcccaggactttgtggcattgttgtactgcgcacgggccttggggtttaggtacacgggagactcgagctcgggcgagtatgggggagcgttcttgacctggaccagagctgggccgccggtcatggagtcgtgcaagtaccggtaggacttggcctggcgcgcctgctgcttgatcttgtatgcctcatactcgtgctcctccaacgcaccgagaatgtagtcggagtggatcaaaaggacctcacctccgacctggccgaaaccgaacgacttgagcagaccggccttgacaccatcggtctggatggaccgcgacgtgtacaagacgtgctcatactgtctcatcgtgtcgtcgatgttgtcggcgttgcggtttccgggaatgagacccgtttggagcacctgcaagacaccgttcatcatccaggcagcagcggcacccttgggatgtcctgtaaggtacttttgccagatcgagggcaaggcattacccttgctgcgacccaaatgctcaagctgcttgttgacgacctcggattcattcttgtcgtttgccttggtcgaggtaccgtggaaggatccgacgccaatatcgtcgatggtcaagccaaacgaggccagggcaccacgaagaggagcgatctggggatcctgtctgtagaactcattgccccacaggttgagggcctcgcggtgctgacgattagcttccttctgaatgcgctcagtctccgaggcaagatactcctcttcggtgacggtgaggccgttgttagccttgagctcgtcgagctcgtaacggagctcagcgtactcgttctcgacccactgcttgatctgagcacgacgggcatcgatctggcgcttgcggtacttgatgtccagaaggcgcgatggcatcttgcccttagcctcacgagcagtagtgaggacaccctgtccaggagctgggaccgagcgaccctctttgtcggtggcagtgttggtgagaccgacgataccgtaaattggcacacccatctccacggcaagcttggcctgcatcagaatctcaataccagctccgtgggactccatgaatccagagcgggtagaggttgcagggcgggacatctccttgggggtacgtccgtgcgcaaattcctcctcggagttactggtcgccttcatgttggcaaactcgtacgagccttcctcctggaagtcgtcgtagcctccgacaatcacaatcttggccttaccactctggatcgtatccacaccaatctcgacagactcgacagcggtggcacaagctccgacgggcgtcttgatgggtcctgaggacgacaggagcagcatgttgacccaggcaggcattgtgttgatgaaggactcctgcaaaatatccttctgcacagggtcatccatcacacgaccgcggtacatgccgcggagcgagagcatgcctccgacaccggaaccagccgtgtttccaacctcggacacgtggacatactggtagaactcgtaaggatcggtgatacccgaggcaaccaaggcctccacagtcgagaccaacacatagagggtgatggtgtcgacctggtcaatgatgtccttgggcactccaaagcgggcagcatcccatccggtggggatctgaccagcgacgagacggtcaaacttgagtgccttgggaatgtacatgttggcacccttcttgaacttgacggcccactgtcccgactcttcctcatagatgtcgaccttgtcgccgtgctcaagcttgaacatctgggcctcctccttcgagacctcaaaggcctcgagatcgtggtcgatcaagacctcctgaagcaaacccttacgcttggggtcatagccaccaaagagctcgggctcaatcagacggataccggtgtgctccagaatctgcttctcgtacttggccttgacatcgcggtccttgacgggctcttcagtcttggcatcaacccaaccagagtagggcgagccagacttcaaattgccgttgtggtgcttgatgaagcccatgatccaggccatctcaatacatccctcgagcgagaactggccgttagcctccatttcccaacgagtgcgcgagttaccccaaggtccgacctcagagaaaccagtgacgacgacaaccttctcaaggtcgagcatgccgcggagcttgtgagcgtgcgacaggtccttgtagtccttgagctcagggaagggaaacttcatgttggcacgaggggtgaccttgtgaggctggtgcttgcgctcggcctcggcaccgtgggtctccttgaagtccaaggtgttctcagtgacgatagccttgcggatctcggccgtctggcggtattcggcacgcaagttggccgaaatttcgttcaggttgggcaagtactgaagaccaccgttcaggtcggcccagacaggctcgacttggcagaggttggtgatcgaggggtgcatgagaccgaggatgttgaaagccatctcctggccagagaaggtgcggacaccgtacttctccaggccctcggccacaatgttgttaccactcatcaatccagtaccacgggtccagccaatgacggctccagtgatggtcaggtaggcgccccaggactcggagctccagcggttgaacaaggtctcgagagcaaccttggactcgccgtaaagcccatcggctccaaaggttccgtggttgggcgacaagggcaagataacctgagcagggcgagtatcgtagccgtgctccatcttcttggccttgacgtttccgagcaggcgcagaacgttggtcaacatgatacggtgagccaactcggactgcgagtcaatgttgtcgatctccttgccctggacggagatggcagcgaaggggatgatgtagtcgaggtcccagccgaggcccttcttgaggtccttgtcatagatgtagttgacaagtgcgtcgacatcctgcttggaacctccgttgaagggaacaacgaccagggatgagttcttggatccgtggcgctggtagatcgactggtagtactctgtcacatcacggctgaagcgcgaggtcgtgacaacaaccttggcacctccagacaagagacccttgaggatcgaggctccgatagagtcctttccggcaccagtcatcaaaaccatgcggttctcaaacgtaacaccatcgcgtgcaatgttggtcaagacatccaagtagacgctggtgagacgctgactgaactcccatccgctctcggactgagggttcttcttcttgaggtgcaagaagggaatggtctccttcttggcctccttcttggggcgatcggcgctaggaacggcagaggcgcggcggacgcgactggcacgacggttcttttcctcacggatgatcgtgttggacatgttcatggcatggatgacctcgccgtagagtgacttgatcgccaacttggaggaagacttcatggtgttctgagccttgatgatcttgtaaatctgagcaaggttcttctgcaccttttggcggttgctgtactccgacatcttgcctccagcgaccatatccttgacatagtgatccaacttgcggacacccacgcgctgaacctcctcgtacaagatattgcccttgttatcgatcgttgtctggggaccggtgggaacgccgactaatgaaaaaggaatgcaaattagaaaaccgcccacaatcgtgtgtgtcgcttgcgagaaagggcaaaaaacaaaaaaggagtaaacttaccatccttgtaaacgggggcggcttccagaacctcgcgacagttctcgatcaacatgttaccaaactccttagcaagagcataagtcttgccacggtcagcagcagtgttgtcgatgtggtagatcatgaactcgagcaactgggggttggcgcggttcataacgtgaatgcactgggccacgacctcgcggtcaacaacagtaagacggccaaaaatcatgtcgtacaagagcgacatggcatcctgacggacccagttccagtgcgagtcgtacttgcgggccttcttgacgctgaaggcaggcttgatgccctcggcgtagtagtcaccgtgctcggccatccactggtcaatatccgcctgcaagcgcaacgtcgccagtttctcttcctcgtactgcttttcgcctgcacgaagatccttctccaggtagcgagcatagatttcgaggtgctggtacatcatcgcgttctgcttggcctggaattggttgaactcctcgctgttcatcatggcaccaccgacggcaccaccagcaacagcaccaccaccgccgccgcccagagagacaccggcacggcgagcataagcctgagcaacagtgtccaaccaagccttagcgtcaccctcggatccgaggcgggcgctgggctccatagtgagacccaagagcaaagcgccatcagcgcggagtgggcccaatccataggacgaggcaaggtaggccttggctgaggactgagtgaatccacctggcattttggatcccatcatcttggcaatcaatgatgtcgtttgcatgcccaaggatccaccgaagttgccctggagagcattaccgagatcctccagaggagcctcctcgcccttctcagggaatccactgctgccaaactccttctgaagatcacctagaatctcgttctgaagagtcgacttgcctcctacaagatccttgatagccttcgagagtgggacctcctcgacagtcttcttgatcttctgggcaacaatgacatgaagaatgtcaatagctttgatgggagcatcggcaatagatgctgcagggccagcagccgcaggaccagcagccgccatcataacgggagcggcgccgccagcgggagcaccagccgacagtgagatacccgcacggcgggcataagcctgagcaaccgagtccaaccaagcgttggcttcaggaacggcgcccaaacgagctggaggctccatcgtcagtccgaccaagagcgcagcatcggcacgaacaggacccaagccgtgggccttggccaggtaacccttggcggtcgagagcgagtaaccaccaggcatcttggatcccatcatcttggcaatcagcgaagtggtctgctttccaagagcaccgttgaagctgccttggagggcgttggcgagttcctccagcggggcctcctcgcccttctcggggaatccactgctaccaaactccttctggagatcacccaagatctcgttctggagagtcgacttgccaccaacaagatccttgatggccttggacagtgggacctcctcgagagtctttttgaccttttgggcgacaatcacatgcaggatctcaagggccttgatgggcacatcggagactgcggcagcaggtcctgcagaggcaacagccacgggggcaggggctgcagcagccacaggagccgccttggcgacgggagcggcagcactggcagcaggagcaggagccgaggactcgacattgtccatggcgtagtaaatctccttggagtccttggacgtgcaaagagtcgaacgctggaaggtcaaggcatcgtcataagcctcgtacttgaacttcagcgtgcgctgggccataccgcagagcgtaggcgaaggtccaacctcgatcaagcggacaacgctgtactccttgaagagtcggtcctgtgtctcaatccagcggacgggcgaggcgaattggtaggcgagcaactcgaccaaaagagtgtatccaaggcgttgttgctgcttggcagtgagcttggtgtcgatccagttcttgaggaccttggccagacggggcgacgacgtgaggttataaacgccctcaatgtacgacttctcgatgctgaagggctgagcagtcaagttgggaatgtacttggaggtcaacaggggcacgttgatgaatgtggggttgatcttcttggcgaggtaggtgcggaagggagcgacaccggacaacaagaagctggagtggaaggggacgtcgattccagccaaagggatagtggcgacaccacgctcgggcttgatgtgaccatccttagcaaccttctcggcaaccttctcaagagcaccggcaatgatctgggacagatgcttcttgacctcctccagaggcatggtctccatcagcttctggagatcaatcttctgcaccttgaggtagttcagaacagttgagagagcgtccaggttcgagagctcaccagcagcgacatactgccagttctcaacgttctcgttgacgatttccaaaagaccgttcgactgtctggcaatagcatccacgacgtaacggagagcagagtcgttgaatgtaggcgagacacgggagggattgatggcaaccattccatagttggagcgaccgacagagtcgcgcggaacagcaacctgcatggtcataccgcggtagaagacgacatcaaccaaggattcgatgggaaggacctctccaatagcagcaagagcagagtactctccgagggagtgaccggcaaaagcacagttgccctggatcaagcccttggagcgcatgtcctcgaaggcggccttctccatgagggtcaaggcaggctgggtgaactgggtggcagccaaaagaccgttaggtgactggaaggtgtaaaagtgcgtggtctcgttgatgccggggaacaggggcaaagacttgatggaaccatcctgatcaacctgatcgtagcgcatcgacatgtagttctgacgaatggcgttacccttgggaccgccaaagtggatcgtcttcttcagagggttgttgcggacaatatccagaatagagaagcctgccgatcgagaatggttgcatggtcagacaaagcattattacaaacgagtcgaaaacgaaaatcgggcaagaacagaaatgagtggcataccatagttctccaagaaatgacgatcggctctctgccaaatgtcctttgcaacaggggaagagtcatacagagccattcccattccctgctcctgagatccttgtccggtgaagacataggcgatcgtgggctgatcaatctcagcagtaccctcaacaacctgtgccaaatgaccgtaaccagcgttaacagagatttcgagaacgattcaagaaggacaattgaaaatataccatggaatgacccggttttgatcttaccttgctgccgttctggttaaaagtttccaccttaatgatcttctttccgttgatcattccaatgtgcgacaacttggtcgaaagacggtcctgaggaagcaccatagaaaggaacttgacctcgtagctaaaggagagaaatagagatattaacacatgtacgccaaaaatagcactggggactttcgccttttcaaacgatgtggaaggaatagatcttacctagtgacacgctgaggatggttctcagcagcaaagatctccacaaacttgcgggtcgaggcactggtccacatgccatgagtgatagtgccagggagctcggcaagatcggcaaagtaagggttgacgtggatggggttgaagtcacccgagaccttggcatagggctcgttgctgaagggggagatgacctccgaactgaaggaaccctcgggcatgacagagtatccaccgttctcaaagtggatggcctgctcgatgggagagcccgagcgcttcaagtaagcgaggacggggttaccctgggtctcctcgtcgttgctgtagtgaacagtggcaatctcgacgtgctccttggtcgaaatctgcatcgagacggtaccggtggtctcgacatgagagaaggtggtcttgttcttgaaacgaacaatcgtgttcagacggaagaccaaggacgcattgggtccgacagtgtgctcaccctcggcccactggatccattccttgctcttcaagactgccacatccttggcggacgtcagcttgacctccatgggggtttccaccgtcttctggaacgtgttctggtagtccacgaaggtaccgcggtacaagaactccgaggtgacttccatgacccgcttgccctcacgcagaacaacgcccttgacctggaccaactttccagagtcgttgttgacaacggcattgatctcggcaacagtgtcgacgatatcgccctgcttcaaagactcggcgccatccaacatgcggaagccgttcgagagatgaacgagcttcaacagatcaccatcaatcgacttggggaagatggccttgatgatggacttccagccaacgacaatagcaaagtccatgggcgcatagacaaccttctgacgacgctcgacataaagctcagcctggtttccgacagcctgacaaaactccttgatctctggcgtactgacctgctcgccattgcaaatgaacttttcggtgaaggcatccgtggccaggcaggcgttgaactggtcttcctcagaggggaaccaaagcttgtagtaaaactccttgatccgctcattgcgaccctccatgacctcatggataggagcatatcccttctcgggcgtgtagtggaagaggagagggaaaggaatcagacgctcgccgttcttctccaccaacacaacctcgatgagctcattgggctgcagacgggcgcgaagagaaggagagagctcgctcgacttgctggaagcagaccaggagcgacgatcgtacacggtgatagtttgcaacttgtcctcggtgtactcaaaatgaacggcttgggaaacacgaggacggaagatgcgtgcaagaggattatccaagaacttcttgccctgaatgacggcgggggcagtcaagagggcgcggaaccaagaggggtcctggccagcgaggtactcgagccagtcctcggtcttgggcaagctcgactccagcatggaggtctcgaccatcttgaccttgccattgtcgtacgtctcgaccttgaccaagggcatgacagcgttcaaggcagactcgaagcgtccgggtttgccgccaaaatactcaacctgaggaatgttggcgtcgtcgttgttgtagtagcgctccttcaaccaggcaatgtggctgtggaagataccgtccagaatatccttgacgggctcatccaccttggtcgcatagcggacggcggcaggtccctggagaatacaggtgcgctgaacatcctggtccacaacagcggccaggtcctcggcctgccagagagagtccttcttgaaccaaacttcaaagtccttgtcgaggacgggaatgaacggcacgggcttttgtccacgacggttcatcaggaacaagaagtatccaacatcctcagtcgtcaggagctgagtcttggtcaaaggataggtatcgacgaactcctgggcaaacgcaaagggaatgtcgagctgagagaaggtttgaacgatcgatttcttctcaacgccaacaaagcgctcctcaatgcgtcggaggatgtcgccgagcaagttgcggtgagagtggtcgatccagcgctcctcatgcttgataaacatgagctcgatcaaacggttgatgacttcctcataggtcatgtcctgaaggtcagcaacgctgccgttggccttcttaccgaaccaaacctaatatttcatagatgtcatcacaaacttttggttaatattcaatcgtgttcggcacatcatcgtacagttgtaagagagcacaacgccaacgactacttttaccttttggaagtcagcgttcaaacgcttgatgatgtagtccttcttggccaaaagcgcagcaggacgcttgtccttgggcagagcaaagatggtgtcgtccatctccttccacagcttcacaccgcgggttgcaatcttgtgaatgggctctcccaattcggagcggacagtcatgacacctccggtcggtcccttgtaggtcttttcccactcagagtcctcgactccgggagcatcgacaatggcctgcttcacaccaagcgaggccatgccctccttggcaaccatcacgcgggaaccaaagagcataccatcgaaaggcataggagggtagtcgagctggactgaccaatcaccggtgaggtaagggtaggtatcctcagctccaccgaaaccagagccggcaaccagaaccacgttagggtgacgacggatggcagagtaggtctccagaatgggctgatggaaatcctcgaaactgtgatggccaccagcacgaccaccagtccactgaagaacgatgggcatctcaggatgggcattagcaatggccaggacctggcggatggactcggccgaaccaggcttgaaagagatgtgacgaattccagcactgagcatatcggtgatgaactcgtctgcaacctcaagcgagggaacaccagcagcgcaacagaagccctccatgggaaggccctcgcgacggagcttgggcaccaagggggcctggaaaccccactggcgcacgttgatgaagagggtgttgagggtgataccggcgccaggagtggtgagctgcatgatcttcttgaccttgctgcggacagcagcctcgttgtagtgtccgccaccggccaactcgacgtggtagccggcattcatcactgcactgacaaagccctcgttcacagtcgagggggtcattccggcgaccatcaatgggggcttggaaaggagacgggacatacgagtgtcgatatggatctcgccgttgacggaccggaccagcttgggctggaactggttggcccagttgggagcatagcgcagagcagctgggttggcgtcaaagatgtcgggtttgtacgaaagctcgcggttaacgccctcagaggcgcctgccagcatgacctggacacccgtgccgtccttgttgcgggccgtcaaagagccgacgcccgaagagccgccggggccgaaatcgatcacatgggtcagtcccgccatagcagtcgccttctcccagtgcacgggaagcgagcagatttggttgaccaggtccatggtgatggtgggcgatcctgcaatgtcctttccagagtcggtcgagaagacggggacggtcatctgggtgtggtcaaagcccaggtcgtaccgcgcaatgtcactctcgaccaaagcagagacaccgtcgaggtacgaagagtggaagggcgcagtgatgggcaagaaacgggacgaaaacttgacctttctctgcgagaaaggaacacgaccctgctccaggcctgtgggggccttgagcttgcgaagagcgaggttcagaccgtacagcgattgaggaggacccgtgcaaatggacgagcgggggccgttgataagcgcaatcttgatcttgcggtcctcgggcaaatggcggtttgtggcctcgacatacttttggacctcagatgcgcgcagagagttgacaaccaacatgggcgtggggttgccctcattgttggagagggagtcctggagaatggcagggttaagggtggtttgagggtagacctcctgagagcgggtaccgatccagaagagaagtccgagcgccttgcgggagttggcaaagaactcttcataagtggccgaggatgagatgaccacggatgagatgattccctgggaatgtccagtcgagccaagaatcacatcgcggagctgggcgggggtctggtccaaaacctgttggccatgttataaagtttaaaagaaatacagcatggggtcagcatcttcgtctctgggggggtggaccatttctaatccgatgctctgggctggatctgcttttaccttgagcatcacatagtaatgcatcaactggacaagtccgatcaaaggcagagagacgggcgcggagaccagatacgcaacatctggcttcgagtctgggcttctcagccatcccatgacatccagtcccttggagtggaagactgaggcgtcatctgatctggcgtgctcgcgcaacactgcggccatgtcctcgacgtagtcctgcaccaaagtggtataggtcgtgtagatgtctgcaagctcgtcaaagtactcctcgatgttgccctgaccgccaaagatggcaaagagcttggcgcttccctcctgagcagcagcaaataatgctgaggtgggcggggtgtagtcctcgggtgcgagtgcctctgtggcgcgaaggaagaccaaggccgagaagaaggcattgatgatcacgacccgggtatcctttgctaagagtcgagtgaccgcgtggatgtcgtttcctttgaggtatttggtgacaaagaacaagaagacggtcctcagcacagggatgaactgcagtgaggggtcgctctacagtgtgggaagagagggaagcgatgcaccgacgtgctgttagccactgcgcttcgtccacggggacagagccattgcagaaccgcgccttggtgccctgacggccacctgcacccactggttgcacaactgcaggcagatcgtgggaaaccaaatgtaccgccaaatccctcaccctgtcaatgaaacgctaaattaaaatttttctggtcgtgttggatgagagtcccaaaaacctaagtgagaggaaagtaccacccagcgctgcgtttttttttctttttttttttcacgacccgctccttgaccgtctcgctgaccccgccccactcttgtcgataccaacccttccgcttcctgctccgtcagcattggaggcagaaaaggaggttgacgacggcgatggagtgagatcgcgcccctgatctccctccaagaggttgatgtgtgcatgcagctcccctcttgaagaagaagggtccaaatcaaagccatggtaacacacactccctttcctcgctcttctttctttcttttttgttgggtgctacatggtctaagggcagccctttttttttttttgccataacctccggaccgcctcatgccctaccgcccacaaaaaaaacaaagatcgctggtctttcctgtttgtctgacgcacttcctgctagtgaggctgatcccatcctggcacttgaagaaaatgtacaaaaaccccattgcaaccacctagcaccatactgttgccaatgccaaaactgccatgctgctttgctttacctgttcgctcttgtccgtagcaaatttgaggaaacgggccaccaaggccatctcgggggcctgatcgtcagcgcctccggccgctgcggcctcttcggcgggagcagcctcggccgagatcaggaactcttcgcgaagctgttcagccgctacccagacatccgaaggaacgaggatcgagacctcggaagttccttgcttgagggccaaaggacgggtcaagttggactgtgtggtagtcatgattaaaaaaaaaggcgttctggcttcttgaagatatggatcttttgtctttttcttgatgatgtagggaatgaagtatcggctttcagcggttaactttttcagagagaacaaaggacaattgaatgcaacttttcaatagggtgttcctgttctcgtcaaagaaagataaaggtgggtgtgaaagaagataatgcaagagaaagggagatacagagaggtatgcacgggagactgcaggctgttctatgcaacaatgaggaatgaacaatggatgcggggagggtgtcgagatggagaggcgggaggagaggcggatgcgggaggagatggaggtgggggatggggaagagagcgagagagaagaagaagagtgaaaggggcggatcgaggtgcaaggcatactaatacagcacccaacagcacacatcccttttggagcctttgatccgcaactacagtgcggtacatcaacgatatcttatccagatagggtaggatctttttcttttcttattcgtattctattgccctctttgtgcttgcactgcagacaaacacactccccagccaacattgtgtgggggcctaagcgagctttgcgctgctcgcccaggatgcgcaggccatgcgatgggcctggctccccgcagggccctagcacggccagccagccccccactggagggaaataaaattttcgctcggctttcttcgtctcagacgaaacccagccagcggcgagattgcccccaacatttgcaccactctgtcgcgctgtccctctggaacgcctgccaggcctcagggcagcccatccacctccgccatcaccaccacctgtatggacatttatacatccctcgttcaatcgccttgccctacctatccattgtctctcttttattgcaatatggattcgattgactattctccgagccctagaaccctggatcgtttgagtagacgagttctaagcggacggcagctactgctagtcacagtggcatcgaatgcttacacacacacacatacgtcgcgttttagcactgagcagggccaatgaatactacatggcatgctgattctttattgataagcaccaacaatttgcaccagtgcagaacagacgacaaggcaaaaacaaggtcgatgcccatatttttttttttttttttcgtgcgaccacaagaagctctggccaacaaaaatccgacgatgcacccaccgagcgaaggggccaagcgagccctcgacgagaataagccccttcaacgccagggactgccctcaagtgtgcaaatatgcaaataacgtttgccgcccccaaaattccaactgccgatggaatctggtcaattttttttttaccccaaggaacaggcgacacaacaacgcggcttgtcttttttaggccgtcctctgtgcctgcccctcactgctctcccgccggcctctcgcgcgatctctttatctcgctgtgccattgcgaccccgcccgtgtgccccggctgcacacttgcaaacacatccagagtcgcgacgtcttggtggcgctcgggctgcaacagcaccccctatcgatcgtccgtccctcccccaactcgatcgccttccccatgcgcccacaaacacttctcatcccttctttttggtattcgctttgactgtgcaatcgcgctgcccttcgcactactagccgcggcatattgcaacgtgtccacctcacaatcacttgtttgggatacacaggcttggctgcaacaaggctggggaggatcggcctaagcatgttcgtcatcgccagaccagcagaggcactgcggccattccgaacgtcccccaccacttctcgctctgcctcagcaaagtgcgccaaatgatacacctactctgctagctgttatcagctcgcagcccccaaatgcaccatgtaacaggctgcgaccacgattgcacatctggtagccaaaacacggctgtgcagcgagcactccgtgagcaatagttttgccgatgagctcgtaggagacgtgatcgagtgacctgttgccaccaaaatgagtatcgagcaactctgccttaagatcttacctcgttcctttttttttttctttcggatcgttgcgttgcagttcggctcctttattgtgcgctaagactccctcactccccactaaccgctcgcctaaggaaaacaggatatctcctctcctgcatccatctttcactaaatagccgttgttccttgtgtttctttcgctgaatatgtgcaggtttttttttatctcgagcctccaaagccggcgccaggagcctggttgaactgatcaaacgcctcctgtccattgttgccgccattagaattcacgttcgacgggggcatagcagagctgcctgcagccaaggctgatgatcccgtcgctccggggacgccatccagtcctccggcttgctgctgttgttgctgctgctggtggtgcatctgctgctgctggtggaacgcatgctggccatggtgctggttcatatgatggctgttttgatgatgctgctgatgctggttttgatgatggtgctggtggtgatgatgttgattatgatgctgattatggtgttgatgatgaccatggggtccattgcgaccataggcctgtccattgcctccataatggctattgttatggtggttgttgtgatgatggccgctatggttattgtggttgttgttgtacgagtaaggataagcgccgttgttctgatgaccacccatagggtagccagaaccattgttgtaataaccataggcgttgctgcgtgcagcgttctcggccgtacgatccttgccccacgacagctattgcaatcaaatttattcataaaataaaaaaaaagttagcggttgcacatctcaccaacgcaatccctatactcatcttgggcattcgcgacatcaaccgctgcaagatacttcaaatacagcccgcatggtggtttgtttaccttggcagggcgtccgttgatcatcgtgccagcgagacgaactatggcatttgcagccttctcgtgcgtctcgagcttcacaaacgcaaatccacgctccgcctgcagtctcatgtcgaccacgaacccaaaaggctggaagaaaggcaccaagtcttcctgggtggtgtggggaggaagatttccgacatacacagtggtgttgaactgaggagcctgtccagtgaccatcttgaacgagttgcctccatgatgcagtcctgtcagcagatacaggtagcacgttagagtagagtgcatagcgtctttgaccaaaattgtccttgtctcagttcataccatgaggatggaaggcaggaccaggcatgccgcgctgactggcccagttgcaacggacagccctgttacccagaatctggccgttcatggttgtgatggcacgctcggcatcctgtgattgtaaggcgtcgtaagttcaagtgtttggacttgctcctgtggtacttttgcaatctgatgcatttgcagtctcacttacagtacgctccttgtaggcagcaaacccatagcccctggatttgccagagttggcgtcccacatgacgcgagcgtcgctaaaagaggagcgatcataggagaagttactacgctgcttgtcattccgttcgcacgttccggaatagagctggagggtcggatcaagcatacgtcatggttccgaaaacgccaaacgctttgctcaaggcctcgtcgttgatctctgggctaatatctccaatgaagatatgatagtgcgctatgtagacaagatttttttttaaaaaaaaagtaaggttttctgcaagctattccaaccatttttttgtccatatcgacgcgactcacatgcagtatcttctttgccagccatttgtccagtgaatgcccagttgactttcagctcctgtagacgacaccattcgcgccatgcaataaggattgtttgtgagttgatttgaacggttgcaaaagcctgtctgtcaaacatcaaatggaggagtatatcttacatgatggaacacacgatatccgttcatggcctgcagggcctgctcggcagttgcatgatctgcaaattcgacgaagccataattcagacccccttgatgcgcaaacttttgaggcagggagaaggaaaaagaggaaaaatgtttttttttgtgttaaaaaggatcgcacgcgacactcatgccccttttcctttgcgatcgagccgcagcctagtcaacccacagcccacaaaggtcaaaacgggcaggttggcgcggaaggcagtacaatgtcatccgccaaaaaataaaaataacatataaaggataaaggacatgaaatcccgccacgggagcagctgaatcgacgactcccgtgcctccacatcatagatcgaggatcgcttacgttcttgtcccggatgattttgacgctctcgaccgcaccgccgacctgcgcgaagagctcctgaagcgcagcctcattcacattctggtccaggttaccgacatagagagtcctggagtcctcgtcaggctggaaggcgggagcggagccggcggcggtggcagttgaggaagcagaggagacaggtcctgcagctgtggaggaggcggaagagcttccgggagcaggagtgcttggctgagaagcaaccgagacagctggagagccctgctgttgctgtgcggtgaactgatccattttttttacaagtgcaaagactggaatgcgagaaaaagattgagaaggatggggcacgtataaacaagttcgaacaacaggtatgacacaacgggaagtacaaataacgagtaaagacggaaaggaaggaagaaaagaaagacaaagagagagaactggtcgagagattcagggacaaaggcaagcaacgagcattagtcccttgagaacgagtgctttccgcttttgttggaatgccggtcgatcttcgggctcctccatggtcagcacagggcagaaacggcactggatcaggcgcaaaccgagcgcgcaaacattcacatacctgataaaaaaaaagaaagaaaagaaaacgagaaccgatcagagtccctgcttgtcctgtcgtcgatggtccaaagaagcaatgagttttgggcgtgtggatgggtaagaaaaaacaagcgcgaatggcatcgaacaaacggttgccaaatatcagcaaggggcgtgcactattctggcgaccagacttgccgactcaaacactattctcaggcgtacagaccacttcttaaggctgggaaagcctctcaaagtctcgagcaagtcgctgcgtcctcattgtcgttgatccaggagagcgccgctgcaaggataagcacggcggatgtcagtgaagtcggatcgatatgttcaaccagcgccctctcttaatgcaaaatatcaagttgaccctctataaactaaaatttatctaaatgaacaccttaaccctctctaattgaccgaagtgggccacctattgttaaaacttactttattccacaaatttgcgatttcagaaagctttttagttcggtagcatctcccacgagagaaggagaagttccaggttcgaatcctggggaaagctaattcctaatgacgacaacaacacctgtcccttgaacaaaccatgtgaggacaaaaaaagattacaacggtatccgagggaaaaatcctttttttttttttttttgtaaagctggttcgatttgagcactccaaatgcacattacctcttctcactctccataagtccatcgggttgtttactctattttggcgcaataatacacgacaaaaaacaaaacgcgtcaaaacgcgtcctcttttccctgctcaatcgctcattcgtcctcttacagcttcagaactgactacatacatgtagttccccgggactttccaccgacaactcagtcgggaagcagtgatcttggcgcatagcggatcgccggctgtccccctgatcatgctaactcgaagggcaggcacttgtatcggctcccggctaagtggccaaagccggctagtggggccaggagaatgcaggcgcagcacccacaaaaatgcccagtcataattgtcgatgatgcgcgtcaagatccaggcgatcaggacagtgactgttcatgggaccgttgagtgcacaaatcatgagtgcatcgcggtcagtgatccgtccacgggacacgcacgcgtgggtatagtacaaagatacaacaagcctgggtggaccgcttgactagaccggcgccgctggttatttcgctgctgagcaaaaggccccgtgtatgctcctcctacatgtggaaacagtagccatgcacctagccagttagacatagctgtggaagataacccctcagagaaaaaagggtagatatgtcagcgagatccacagcttcaatatcattcaaccttgatactcagcacgttcaatcgaagagatgctggacaaacatacgtttatttcaataaaaatgtggatatcaaaaagtaaaaaagtgtgcttcctcggcacattaaaaaggcatttgctttctgaaagcaacgacgtaagcattgctgcgtctacctagcgtccagtgaattctgtcataccacagcgatcaggtccattttgagggttgcaagggactgtgcaagccctaggagactccggtctggcacttgcatagtcacatcggtagagcattgaagcctggaatccacaaagactggggaaagccgcaccacagacctaagtgaaaatagaaaatttaacaagttagttcgatacactgggtgtgaaggctcatagccggaacagttgtgactatggcgtcagtggatacttactgtgtcaacgtccttgcactggcactctcccacacaacgagcaccactgaaattaggaatacagaggtccgcggggccgcacttcttgtacagcgtcggaatggcaccgatggcagagcacttgtaggtactgccttgttcataattacaattgggatcgaactctttgccacaaacctatggacatgacaagatttgcgtggacaatgagctgctgctgtctcgattcaatagaagtatggtgaagcacagagccggtgacttacatcggcagtgcctgtgcacttgcagttagtgtcgcatttgatctggtttgtgcatcgtcccacgccgcattgagccactgttacaggcctggtatctctgccaccaggacagcccatgacttgattttgatcgtagccacactcgaaggggaagtacgtggagcacatctataatagtttcgtaaaggtatgtccctatgttaatcctcggcggacgaatgagggatatacgccagcctgtttcaaggtacacttacgccataaccatcgttacagaggcagctaccgtcagtgggcttgttgtctttacagtaggcgaacgggaatggtttctttccaatcgaacaagaataatagagatctggattcaagccaggacagggcagctgcccaccacagaatggtccattctgcgtgcacagacagtcctcagtcggagcgcattttcctccattgcactttcctacagggcacactgtgctcgggatgggagtggcgccctcgttgttacagatgtaaacagtgtcggctcgcagagttgaacagatatccttcccgcacaactgtccgatcgacttgcaggcgcacggatcaacgaaacattggtgtgttccggctctacatgctccaggcttacagacctccttcggaacaggagtatccccaatgttggtgcaaatgtagagagtgtccacactgagaccgcattctgcaggaaagtcaacaccacactagcaaggaaggtgcacattcattcgagaaagcatcagtaacattgaccaagattgcagccacaaaaaaaatatcttcaggccaacttactgtatcgaggttggtcttgcatgtgcaatcgggttcacaaatcgccgttccattaaccgatgcacagagaccacttttgcaagtgatactcggttgcggggtggcaccttgtccggagcacgtgtatattgtgtcaggggtaaagccgcagcgatccaggtagtctttgccgcatgtctagttgcgatggatcaaaatgtaaggctcctttgtgcagtgttcaacatagatctgtcattctatggggccaaatgccgatgcaaatttaccaatgctgcagttccacacttgcatggatccggttgacacattgttgttcctgcaacgcagcctccggtgatacactgttgcttgactagagggtcatcacccgcattcttgcactcataaagcgtgtccttattgagcatgcacgagggatcaaacgcggatccacatttctaaaatttgataattccacaaagcttaacacggcgtacgttccaatgatgcatcagtggtgaatatgacgacgaaattttggccttactagttcggtcttggtgcacttgcaagggtcgggagtgcactgaccggagcctttgacgcagccagctgtgcaagtggtgtccaatatcggcttctctcccactgcagggcaattataaagcccaataggatccagtccgcaagtggcatcaaagtccgacccgcaagtcttatagcaagatttgcataaaaataaaaataaaaaaacaggatgttaaagcagattgctaaaggaggcattttagcgctccgttcagcagatatcttttcttaccggtttgttggtcgtgcatgtgcaaggatcagttacacaggagctcgtcgaagggtcacaggtaccagtctcgcacttggcaacctcaaccggacgaactccagcctcagtacacgcgtaaagcgtatcggggtcaaaattgcattcggcgggtaaggttgagccgcaataggaaccaggtaaaacctctttgcagaggcatggatcaggagagcaggaggctgtcgtctcggtaggattgcaggtttgtggggtgcagttggtgatgaagataggatcttggcctgcccggtccttgcagtcataaagtgcgctgtcaatccatccgcacgtgctgttgaatactgttccgcagatctattggtttagaagaagacagaaaagcgtgtgaacgttcaggtaagacgcgactctagttgaaatttcgtttaagctcttcataagactgattctcgaccacgtccttgcctgttcctttccagctgggcacttgcagggatcgattggagtcacacagctgccagtatcgaggtccacgacgcattgagaaggaagggtgcattcttgaaccacggtgggtctcacgtcttgagctgggcagtagtaaagcttatcgctcaaatagccacactcagaggggaattgacttgcacaaacctattcgcgagataatagttgataggtacgtcagtagcattttggagttttttctgcagtaaactcagatcattctctgcgtccatcgtcttacctgcttcccgaccatatagggcgtgcacgtgcaaatatctggtttgcacttcgaagaaacgtctggcacgtcgacgatgcattctgtggagcatttactgtccaaggctggcgtcgatcctgggccttcacacttgaagatctgctgaggatcttgactcaggccgcaggtagcagggaaatcgaaatagcaagcctattctcaccaattagacagcatcatgaacaataagttgactgaaaacgaacccagaaagttaaaggtgtatcttttgtttgacaggctattcaacctaccgtttgttggccatccttgcacacacagtcatctctttcgcaaagcgcggtgccattcagaatgtagcatgcagtcggcgtgcactcgcttatcagtagagggtacttgttgccctcgcactggtaaatgccctccggcttgagcaggcatgtctcggggaaagagctgccgcaaaccttttaatgaaggaggcggatgttaaatcgctatccttcagccacatgtcaaaaccttagcctcaaaactactacataccgttgtgtccccagccctgcacgcacacggatcctcattgcagcgcgccgtgggcggtctagagatgcatgtgacaggagaacagtcctcaagcttggctgggtttttggggtcgctacaagtgtagaccgagtcgggctcatagttgcatgtcgccgggaagtccgcgctacaggcctaatttgttcataagaaattgcgtgtacgtacaacaagtcaatcgctgcgcaaagaaattcgttccagcataaccagactgaggggtaaagaagcggcagctcagagctccagtcatttcggacagcttacagttatcgcaccggcgggacattcacagagagggtttttgcagatggcggtgcccgccaacgcattgtgctcacacttttcaggggggcagaattccttaagaactggtggctcgccagccgtgcacacatagacagagtctccaacaaggccgcagacagacgggaagtttgtatcacagaactgtaaacaggagatgtggcaacaagcaaaaaggcgtgaggaataatttaacaccatagatactcaggcacaagtcatgactcttggctttacctcccttccatcagaatcgggcttgcaaatgcagtcatccgtcgagcacttggggacaccgtcgaccgcgacacactcacctggagaacatgccctaataggctcccattctccgccatctgcgtagcatgtatagatgacattatcgtcgtactcgcactcatcaaggagtgtgctgccacagacctagagtggagttaacgatagttttgtaaagttaggttcaatttcatcactgcaaaatgcgatatacgcccgtcatccatcttacatttttgccaatatcgccgctgtggcaatgacaaagatcactgtggcaagtcgggccgttctgctcgttggcacacacgagtcccgaaggacattcctcgataaggacgggtttggccaatgcatctgggcaactatagatagccgtagcagtgtagccgcacttttcagggaattctgatccgcagagctggacataagagaaggacagagcaaaattgatcacgatcagaggatgcgcgaatcggcagagtcgttcatcaggcaaatagatggccaaaaagttaccctttcagtggcagagctgcaaagacagggatttttgtcacattgtccaacatcattcacgacaacacacttctcgggtgcgcaaacagcaacctcaacggggtcgcctccgactgtggggcaggagtataccacatcataattcaaacggcatgaaatcgggaatgaactggcgcagacctagagtatcgtaatggcaagataccacatatccttcgtgagcaatggtacttgtactcatcaagccttcaccactgatgtcttactgtagcattggtcgttgcgcatttgcatgggtctttcgaacactcggcaatcctttcgttcgagatacattgctgagggtcacacgacgtggcaaggacgggcttgtctccagtttccaagcacgaataaacggtattgggagggaaggagcacagttctgggaaagaggaaccacagtactatagacagccggaaagttgtcagcagagcatttcaatcacgaaggctaaaatgccgtacaatcgtgtcccttatatcttacagatcctgcatcgacgcagttacacggattgggtttgcactgagcggtcccatttatgctcaggcacacggaagggtcacatgtttcgacgggaaccggcttgcctcctgttcctgggcaagataaaatggaatttttctgaagcttgcagtcgccggggaacttgctatcacagacctgaagttgagaatcacccagggagataaagtttcggcttgatcagttaagaaactatgggaattttagaagtatgggtttgcgcaaacataccagttgctcgcctgggtcacagtaacatgggttcggtccacaggtatcttggtattcgccggatgttgcgcccggatatgcgaaagtgatgggaggagcagcgcctggtatgcattggcctggtttacattccctcagcagaaccggcttccggcccttgacgcaaaaatagagagactggtcgttcaagccgcagccggggaacgtgctgccgcagaccaagccgcctgcggggcactcgcacttgtcgaaacactctccttcggtatagtcgcatgcggtggtacaagtgttgttttgaataaagttgcctccagtgcagatgtatgtggatttgagatcgaggccgcaagtgggatcagccgcggctccacagatctaatggaaaatgagaggaggatgagaggtctgagcgtacgttgtaccttcagttcccgtagcaataggtgttttaaaactattcaggcttaccttcgcatcctcgtcgccgcatatacagggagtttcactgcaggttgctcccttggaggtttgggtgcaaacatttggcgacaggcattgactgatttcaatggggtctttggtgtcaacacattcgtagatggaagtggcactaatagggatacgcgtgcatccgtttttcacaatcaatgcgccgcagatggtttcgtttctaaagcatttgcaggagtcaggcttgaacgggtcgacagtttcattgcatccccctggtggaaatttggcgatggaaagaggtctgtcgccgggttcgccgcattggtatttggtgtcagggtcaagcatgcattcggctgggaactcggaaccacatggctgagtcgtggagataatgtccataaagatggaaaataagtataagtcaaaataagtataagttagcacttcgcaaacgactcaaacaaaacacttgtcattgctacagtggctacttaccgttcctttgcctttacacctgcaggtgaaaggacgttcacagttgtgtccgtttccgctgcatgtaccgaccttacacttttcgatcgcgatcggcgagtcaccggtctcggagcagtagtagattgtatcaggatccaacttgcagctggcgtcaaacgaggatccacaaatctatatacaccaatgaatttcttttagcacgaaccaaacaccatcgcaatccatggccgcgtaatttctcggatagatttttaaggctacctgctcctttccattcttgcacaggcataggtcaggggtcggattcacaccgcaattggtcgcatcttgtgggcaaatgtccgagtcgcacacacggacaaattcaggtttggatccttctctcttgcaaaagtaaagagaagtaccgttgtatccgcattgtcctgggaaggatgatccacaaatctgtttttttgaataaaagcaatgagaggatgacagccgtgttagaaaaagaacaccttatcctcagtcgccgatgctccgcatattcttcatacctgtccagacgacttgcaaagacatgggtcgggatcgcaggcggtagcattggcagggcatgattcggacgcacaagactctatctctgagggtgtgcttccagcttctttgcagtaatacaacgacgtagcattcagtttgcacgtagcgtcaaagctggccccgcagatcttttatgacagcataaaacgagcaatacttaatacacggtatcggttctcctctctataatcatatgaaggacctgtgatccttacctgaccagaggtcttgcacacacaaggacccaacgccccacattctttctggccgctttcgcaaaccttggaagggcaaagtttaaggaggatgggcgggacaccggcatcgtcgcactcatacagcgcgttatgaatgaaagcgcaggagtcatcgaatgtcgcaccgcaaacctaaagaagaggatatcgctcgaatgagcttttcgttttcgtttctggaatggagtggtattacaaccacaagcctccaaaacacgtaccgttcctttctccttgcataagcaatttcttgcaggcacgcacgtgttggtgctacgacggcatcgcccggaaggacactcctccttgaacacaggacgttcgccttttccagcacagctgtagatggagtttggcttgaggtcacagtcctctgcaaagttcgacccacaaaactattgtgtacgaaaggacaagcaaaacgcgagagttcctggagtcaaaatcatcgtccgagagaaacaacgagggagttgtgatgctattacttacatcacccgcaccctgacaaacacaggtcttctcctcctcacaattgtctgcgttgggcggacacacgcctgaagggcacccctttttgaagatgggggcgtcaccaatctcaaggcacgtatacacagcgtctgtccgaaatctgcattcggatgggaacatcgatccgcagagctataagcccaaaacaatgaaacaagggagaatgtccaatgtaagagagagtctaccagaaaaagaaatggttgtatttttgccaatggacttacatcgcccttttcagtgcaaacgcattttgaaacagcttcacactcctgcgcattggcgggacactgtccagatgggcattcgttcttgaaaatgggacgttcaccctttgcaccgcatgtgtagagcgcgctgaccttgagaccacagctgatcgggaagcttgatccgcagtactatgacaacgtttaggatggcaagatctttaggtatcagccttttaggtttcgtgcaatggcttatcagtctatggctgcacttttgtgtttttacttacatcacccgcatttgagcacacgcaatcgtccttgtcgatagtgcactcttcagagttatcctccaagaatttaggtaattcgcccttaccggggcaaacatagagtgcctcaggagtaaggccgcatttctcggggaatgtagagccgcagaactactcacgatgttggtatcattgaatggagtcaagttcacgattggcataaaagcttgaatgcacgccgctaacactcggccatgtatgatgtccttacagttcccggtgcttggcacacgcattgtgtgtcgatggggtctttggaacaagcgtttgagccagaaggacagctacttccggtgcatttctgatgcaaggcgggcgtcttgcccacagtgcaaaagtaaagcgagttctcgtcgagccggcaggttgttggaaaagaggagccacagatctagatgattgacaagtatcgagaaaatgaggtgagtgatagtgtctcgcggccatcgttgtagagaaaatgtgaaaaacattagcgcgacctctaacgcttgcaaccgcgttcccttacataaccagtttcggcgcatgtgcatgtgccatcaccacagtgtgcagttccatttctgtccctgctagacacgcacgcgccaatgttacagacttcgaggagctgagggtaattgccaatggcatcgcagtagtagagaccgtcatcgatcgagttgcagccaaagagatcaatgccgcagaaggttccaacatcggtgcacttgtcttgccagtggtgttcatctttgcagtctccgtccgtgttatgacggtcgaccgcgttaatggctgcctgactgaacgaccccaggtccagtaaaggagatagaagggcttggtctgggcacgtcagctgcgtgtacgttccgtcaatgtcttttcgatcggatttaggacagggcttgtgcatgggtatgacatccgtataagcgacctctgggcttttagagggccggcagtcaggatggtcatggtcatgttcatgttcatgttcatggtgcgtcttatgagcatgagagtggtgcctatgcattccgtggttcaaggccgtgagcaagtccctcttcaccagagacctcgcccaggcatcgggatgacggagtttgccatggggacagtacacggcactgatcgtccggttattacacaccaggatactaacagaggctactcatgggtaaaaaacaccgatcgaagctcttggtcagtacgaagatcacaaagcgcaatattctcggcctcatgagcttagaaggtggtgatttcacaactaaccatcgccacgttctccgcactctttgtcatggtgctcaatgggcttcttgtggtcaacaggcttcttgtgagcctttttcttgcggtgaacttgctttcgctggtgagggcgattaagattgtgcagattcaatgcctgagggatggtcttgacctttttgtgtgtcgtagaaacatggtgatgatgtcccgcctgtttctttccattgccagactgaatccagtgtgtttggtgctgatgactttccacatgatggtggtgctgctcagctccacgcttctcaatggccggagtatctactgtggccgcaacgcttttgctggctacagcaggctccaaaagcgctaccatccccgtgaagagtaaggccgctatgcatcccaggcggatcgaggatcggctggaaggcagcatgattgcaatgcccaactttacggccgggaatgagaatcacaaatggaggaggggggatcgggatacgacggtggggaaggaactttcagatctgttctactgtgttgctatcaacaggagcttgaatagcaacgaaggtgtgaagaggaaagaatggaagaaaaagcgaggtgcaaaacgaagaagctatatgctggtcaaacatgttcattgacgacgcgagaaatgggggaggggggagttgaatccatggagtacagtaacagtcttccacagggtccttctagacgtaaatccctagcatcgacaccgttcaaccacccttttttcatgaacagacctcctttctactcccctttttgccgccctttcctcggccatcgaccacattctacaagcatttgctgctcccgcccctatttgtgttcaccctttttcaccaagccaaaaaaaaaacaaggtgaaagttaaggatgttcgtcgaccatcactaagatctatcaatgatcaacctgagagcaaaggggtcgtgcagaagcatctgcagctatggcgtcaaggtttcaacagcagatgttgccagttcgcgacatcggcgtgtttagcaggccccctcttccatcgtctttcacctcaagactcgctttgctttctgcgatagggttgagagagatcatcgattgactttcagagcatcccatcctgactttccgattttcattgagacttaacacatccagcagagtggaccatgcctcctggagcccgtgatcatcttcaaggaccgaattcaggaacaataagtagtcacctgatgctcgctttccgggaatgaagcgttgtctcgatccagggcgctcttagcactcgaagtgttagcaatccgaaaaggctgcaaaatggtaaggtatatgactaatacgaagggccttgcgacagagtgcgtcgatacttcacgtgcacaaaggcagtcgagtgtctcgctcgcagcacatgcatgcactggctaggcactcagtatgcgaggcagtgtagtactagctttttggcagtaggaaaacacagaagtagcaagttgtttaattgcacaagcagttggccggttgcttcattcaagccaaagtgtttcagtagcctttggcacgcccgtacgactggcggggatctggcgtcaataaaaaaaacagaagcatgcatgcagtggcctgtcgtaaattgggtaatgtatcagtctgccacccagtccgtgttcgctgacggccagtgcgcatgatattcagatgtggggtctttgagacagccttcgctccacgagggcaacgagacatgacagggctgactgaaatttggtaggcctaatgtgggagtacaatctcgcgagcatggggcgatgaggacagtcaagggtcaatacaaggataggagagatcgtaacagaacgagtgaaaactcagaggatggtctcagtggcattgccgtggagtagcgcgacgagaccagtccccaatagccttcgagatgcgtgggacgccgtgtgctaaaaacaagagtagactaatgttattaaagttaaaacgtgcgtgggacatcggtattgtggtactgctgaacggcaaagggccaaggtcgccgaacaaccgttgcgttttgcgtgtagcagcacatcattgacttttgtgcataaagatgcacatgaaaaagtgacctgcatgcttttcaatgagtgttgttatattcattgtgctgcggcgtgcatacacaatgtaccatacaaaaaacccgttgcataatggggcagtgctgagtggcaaaagactaaagagatgggctctcatcaaaagtcgatcttcagcacgacgtgttgcaactagcctcaaaaaagttattttaggtttcctcgttgacaggccctcgcaaagtgctgagtgatgtctggacctgtcgaggacctcgcaggtttgtaacgagagaagcgctctcaagcgaaaaataaaaaggggaaagaacagtgccacagttttctatttcacactcgaacacagtcgcgcgtgcatgtacagcaccggggtttgatgctccgtacttgaccagtgccgttactcacacacgcccgtcaatggagtggacctccgtaatcgcggttgaaacgtttgggcaaagggtgtgtcgcggacaggactgggtcggactctctggcgccccaagcggcgaatgtatgtgatgtgccctacatgagcttatgtgaaagaaatacgatgcaaacaacaaacaaacaaatcaggaagcgtgcaatttcgcggtagactcgaaaattcaggccgtccccttgatcccttctttttttgcccttgttatcggcagacggcaggagagccccaacttacagctccaccatctcctcgcacctcctacacccgctcgcataaatagggactcggtattgttggtgcctctgttttcttgtcactttcactgtcttgcctcaacagctctgactcttgtttcatcctcggcactgtccctcacagcttctctcctacctacctcgcctgcactcatcttgatgcgttcatttgtcagggccgtcggcctggccgccatggctaccttcgccatcgtcgcccacgctcaggagggtggtctgacagacggcgtcagccgcaattctggtgagccgttcaaggacattatcggctacaggtcactcgctctggccgaagggccattccaacctctctctgttcgcaatactctgcctcccatggtcgccagatcagactctcttgagaagcgccagagctcctgccctgttggatacggcgactgcaagtaagaaagcttgcaccgacataccgacatgaagtggcccaggttttgaagaagccgtgcagctgacctttttccactttttctccctttcgtgcagaaacggcaagtgctgcccctctaaccagctctgctcggtggctgctggcggatgctgcccttccaacttgggatatacctgcggaggacaatactgctgccctgtatgtgctgccttccctatatctcacctcaagaacaatcacctaatcacggccaaacaccactaaccatttgtttttttttttttttcgttctagtactctttctgcacagcggatgggcactgcggttgctcgtctgcaagtgagactcgttgtggaaacaagtgctgctactatggatgcgatgccagcggtaagctgacgctttgcttggttctatcaagttacaaggggaaaccagcgacactaggatctctgtcaagtcggccgagtaactgatccaccattctcttcctcgtaaaacttttaggtggctgcgcctgtccttcggcttatcctaccgcctgctctgacggtaagacctgctgccctgctggtgcaatctgcgttgctgggggcaagtgctccggtggcggtgacggtactttcccttccctcccctcgctcacctctgcggcccctcagcctactaccggatcgggtggctcgggcacgggtggttctggcacgggtggctccggcactggtggttctggctctggaggacccaccagcattcagctgccctcgggcggagtgcgtgagtacagctcgggcgccatcgcagcctttatgggcatggccgcagtctttgccgccgtctgagaggagcacgagtgcaaccgcaaaaaagaaaaaaaaacccccccccaataaacaccccttaatagcctcgagtattcgtcaactttaaattttttttcgaccttcattctgcactctttgctcctccaccgcttccccacttgctgcttgacaactgcatgatacgacctcgccttctgttcgacagccatccgtcccaacaccgctcagcaagagaacagcagcgaacaccgaagcaaccaccgcactgaccagcgactctgtgatgcagcccgccctcttctcgaacgtgagaacaaacctctcgcacctgccgcggtcgatttccccacacctggcttcgcccacttcgccggcctcggcctcgtcctccatccgctcactgtccccaagccgccactcatcctctccacagctgcgctcgcggtcctcgtctcccaccccccggcgtttcgcaagcgtgcttgcctatcacccctcaccgcctcctgacaacaaccacagtagccataaaaggcgagctgcctcggcctcctcggagaacttgcctcggtcactcggaagggaacaagagtcggacgagcctggggatcgacgctgtcaaaagggcagtgataatgaccgggatgaaagcccgagccggattgctgtcaggaacttggaggagtcatggaggcgatttgaactggaagcgtcagcttcgccgtcgccctccccctcgtcctccccgtcgttggtgtccacgcaagggacgtttgcatcctcgtctccttccccattgtcaaagccgctgtatcgggagctgattgagtgcacatcgctcaagaagacgagtgaggttcaagacaagcagagccaggggggcgacagcaagaagaacacgcaggtggagatgaacgcatctgccggaagcgaatctgattccttgtcctcctcgacagcgcagagggagcaccatagcgctctcgagatcgatcgcacagacataagcacagacatggacaagagcatggacacaaacatagacacaagcacaggtccacacgcagacacaagtacggacgttgagaagggcacagcaggaacagggcacaaggagcaacgagcgtctgcagccgaacaatcactctcgaatccgctgccgtcaccatcagcgccgagctcgagtataccctctgcgacctctgcagcggtatacgagcactataatccatttccccaggaccaaaagagcagctttcttgcttctagtgaggcacgacttatcctcgatctgccctcactcctgggtaaagacccgaatatgatctctgatgtcttggcgatgcccgtgcccttgcagtcttcccagacccagcgcccatcgtcgtccacatcctcgccgttgacatctgagctggatgctaaagcggaatcgacagccaaggccatgaccaaacgatatgcggccaggaatctaaatatgaccgagacggaggcccatcgcatggtgcaggtgatggcggcagagattgtggcgttgcatgaggagcgggaggtcatgcttcaaaagatgcaggtggccaaggaggaaatgctcgaggcagcgaggttgctacgcatcaaggctgatgtatccacggataggcaggggcgcgagactgcggtcgcagatgccagttccggtgaggcggaggagatgcaggatatgtcgatgaagcctaggttagtggagaaggcgggggacgagtctgacgaggatgagcagagtggggcatgtcggcactatgatcgcgacaactggagagatagagaataaagggcttttctttttcttttctcttcgtggatgatgttatcatagtaggcagcacagggatatgctaatggctttgaagagacggggaccgtagacccacaagtggcacggtgtatgcgtcggtgtgggtgggagagagcctcggaaaccaggtcttgctcgcgacagaccatgaggtgctcatgctcgcggtttattgtcggcggttctttgagtcatggcaacaggttttatcaggatgtggagagtgtccatacccccgtgtccatggctccataaaaagcaagtctacgttttttttttttttttttttttttgatcctttcctcgagatcagaaggactaattctacaacgccactaacaaaggacaaacctcatggaggtaactgacgcgggaaaccagccatccaggagcaatgcgagagacacacactcagagagacagagagtgcgctggttgagaatcaactggctgtgtcgaggtgtgaagcacactccattaaactggactctcattctttttcttttttcttgcctggatgcggtctcagccaacagaatccccaacgtggtacacggacgccgaaaagtactgggactctgtgccggcgacgatcaatggcatgctcggtggtcttggccagcttgcccgtcccgatgcggtgtcctcgctccggttcttgtccgagtttgtcaacccacctgccacctcgtccgcctcctcaatcgtcaatcctctcccagaaagagccgccaccagcacagtcgccgacggtacgtcaaaatcaacctcagccaaacggcagaagctgcctttacccgggtcgggaccatcacatgtgctggattgtggagccggcatcggtcgagtgacaaagcaggtgctgatcaaggcatttgaccatgtggatttggtcgagaactcggccgcatttgtgaagcaggccaaggaagagtatctcaggagcgagatcgaggctggcaaggttggagaggtccggtgttcgggcttgcagaatgtgcagttcgaagggaccagctgggagggccgctttgatgtgatctggtgccagtgggtccttggccacttgacagacggtaagtcaaatacgtgtatgatacgtggtgagttgatggatactagactagatgatggcgcgatctgacgcggacgaaaatgcactgtatcctttttttttttttgtttttgtttggatagatgacttgatcgcgttctttaaccgctgcaagaagggtctcaaggccaacggcctgatcttcatcaaggagaacaacgccaagatcgggattgtggtggacgaggaggacagcagcatgacgcggtcggaccaggtgtggaaggatgtgttccagaaggcagggctgcgcctgcttcgggaggaggtccagaagggcttcccctcgggcctgtttgcggtcaagatgtatgcacttgagccgatctgcttacaagagtagcggataggcgggttgtcagagcaaatgaaaaaaaaaaaaaaaaaaaacaagcagtccccctccccctgtcatttctcaccaccccttttttcacagtgttcttttttatctgctgccctatttgtcaccgtcgttgcgtgttctctgcatcagccagcattgccattcctcacactcacccgctcgcttgctgacctgtcccgacgagtccacgcttcgctgccgccttgaacactatccgaaccggctcgagccacttcactcccaccgccacctcacccacccacacacacacacgtcccatgagcgacttgaccgcagcccccatggatgacgaccgtcgtcgcagagagcacgagcgagtcgtgcgccagaggcggcaggccgcagagaccgaggacgacctcctggccatgcaagaagagttttacaaaggcgcggatcgtcccgcagcctccgtcgtcagggtccagcgccctactctcatcaacagcagtatcaggaccacaaccttccaggacagcaacgacgaggacgatgacgacatacccccgccgctggagaaagacgtcgtcacgctcgatggcgacgaccttcctgtccatccacccaatatcgaggccgcacacgccaagctgcgcggcgggtcgaggttcctgcaggatagatccaacaagggaccccggacacactttcagactgtgggcgagcgcttcgaaatcaaccttgatgatcacaaggaggagggcagggatgacgaaaagactgcagcctctgcagctgcggcaggagatgagttcgagacggaggaggagactatgaaacgtctggatcgcgcaggcgcgtcgatgggtcagatcttgagcgaggtcctggaaaagccggtggtagaagctgttgcacccgtggcggccaccaccacctttggatcactcgatccagcgacgcggcctacaaaagcaggcgtcaagggcaagagtttgtttgcgcaacggttagccaaggcacagggtcaggcagcaccttctgcgcagccttcgacctcacaggctgcctcgtctgatccagtagcagccgtgcagcaagacacggactatatcccggcttcaggctcatcctcagtgctctcgtcaagaagcacaaatgaacggaggatggtcgaaacgccaaacccaggtaatggcttgagtgcgtcacccgccagctcacccgtcttatgcgattcaacgtttagacatggctcccactcacagatattcgctgttttggttatagacgatgctcgaccagtcagacctgctctcaggccctccacaaaaccgagtgcattgccatttagtcaaactgcacagtcaaatcgtaagcactctatgctattattacccccgagagacgaccaagggcgtgaacgggaaccggcgctatcgcgattaatcgtcatatggtatatcgctaacaaactgcaactcttgcataatttagacacatctctccctccaaagccagcgacgcaacttcactccgtactcaaacggacgccggattcgcctcacagcacactgatggagcagattgacgaggaaaacaagcaaaagctcgcacagatgtccccagcagagattgaggaacaacgcgcggaacttatgcgaagcttggacccggctttggtcaagaagctgttgaagcgcaacactgtgcagaggcgcgtcagcttctcggagggggtcaaggtcgaagacaaggttatgaacattcacgacatcaagcttgggcgcgaacactctgcattccaggcgaagcggcacgaggaacaggaaggcgaccacccgcttgcgttgaagaaaaagtattatgctgacgtgccagctgaaaccgagaaactagaatggatgggcatcgaggacgaggctggcgctggtgctcgatcggcactaggaaagtctgtagcgccaggaccacagccgtatactgttcaggaggaggatccacctgcagcccattaccgcttcgatttcgcaggcaggattatcaacggccaggagacgcctgtccatctgggcctgcatcatcatggaatggaccccactcaggcaggatacacactctcagaactactgcaccttattcgatcgacagttcctagtcagcgaatcttgccgctcaacatcgtcgccaaggtcctcgtcaactgcagggatcctgcgtttgagtcctttgaagtccggtcgggtatcttgcgctggttgcttgacacgcttcgagccccggtttatcttcgtgccgccttggacgacaagaccgattctggacttgtcgccgctatcaacgttatttgtgcatgggtgagacctcaggcaaatatgggtcatccggaagatgtatgggagtcgcttgatcttttggacaggggctatgaacgaatcaatttcgcattcaagtaccagaacgtaacgcgtttcgccaacatggaactcaagcctgatacgctgcaatcgagccaagagcaagggacagaggacgaggagacgatcgcggcgcatgccattatggcttccaaggaccctgtcgatggcttgctcgcaatgaacgtcattccccgtctgcgctacattttggacgtttgccaacttccagctctagccaacaatcaagtgctcgatattctgctgacacttgtgaggacccacccagaagcagcaaagagggtgtttgagtgcgaagggatgatatcgacgttagttcgccagtttggtgccatctcgtggccgtctgagaagaatgagctggagcttggctgcacagtcaaggcgatctccatacttgacactgtgatccgttcatccaaaactctggcgtccgccgtgatcgagttgggtcatctcgaccctctgcttcggttccttgtcgtcactccagaggccacagtcgaaaatcgggcgagctttttgattcagacccagatcctaaagctcttccggtctctgtccgcatacggtctctactgtaacgtccttggtgacagtctccagtcctttctgcttcaggacgtggcgcaaaccatctcggatagctgcaaggacaatctcgatcctactgttcgggcctttctctcaagaaagctggctgcatttttccagctcgtcaccgcctggacgcacgccgcagcggacgtacatcgcaccgtccctgagcattcactctgctgggcacaggccgccgcgtttctggacctggctctcgatggaatcgcacactggagacaagccgagcaggtcaaaacaaacgacttggaccacacgttacttgtcgcctcgaccgtgcggtacatcagcacttgggcgcgttatctcgcgacaaatccgccggacaacacacaggttttggagcgcgtctgggaggcagttaggtttcaggactgggtcaagtcggacgctttcaaatctgtacacgccagactatcgatactcctgagcgaggtccctgagctatcagaggctccgttgccccacataggagttacgatgagcaaccccccggccctctccggcatcgcatggactctgtttgaggtctcactctactccgagtacctgaatagccatcttaccgccatgtatcaccttgctcgcctcacctctgcgccagagttcattttacagcagactattcagacgctcgttgcggagccagtgtttggactgattgagcgcgtgaccaaatacgagctcgcgatccaggacaagatccccgccatcctaccgccgtggatggccttcatctcgagacacggtgtttacctcgtggcgcattggctgacagccatggatgtgcttgtttaccaacaagatcccgacaacagctcgcacatcaagctgacgttcttcccgctcttccaggtcacggctttatcgttgctccagattgtcctgcctggagacgagtgcttgagccgggacgtgcttatcaagatcttgttcaacccacagcttctcagtaagttgctcagtaacaacaccaagcagattaccgtcgtcaagcgcattcttgagccgttgtaccttcagtgcttcatcaaatcaagtcaggatctcaagcggtcgcgacatctctggagtcacgacggtcggggtatcgaaagcctcgtgatgaactacggcggcatcactggccagcctctgttcaactggttgttttacccgatcgagctgcttttcaagagcaggctgacgtatgtggaggagtcaggcacattgattgctgccacgtcagttattcactgtaccctggactttgtttattccttgttacaaacactggacggtatttcgtttgagctgatctatatggcggcactcaaggtgctgagcttggagggcgagaaggagccagcaaggcaactggacgaagacgacgtggatgaatcggcccaaaggtctggcggcgatcaggatgaggacggtgaagaggatgaagaggaagaggaggatggatttatggatgaggaggtggatgcgaccatcaaccggttactggatcatttcagtactcggggcgactgtgagttggtcagggatgactcccagggcttgaacaccctttccgagaagactctatcccttctgacggcgcctttgccgttctcgcagttcttgaagaattttatggagaactcgttcgtcacaggcacgctcttgcagttccagccaacggctgcgcgtctactgtttccggccatggtcatgtcctcggagctacaacggctaatttggtacgagtccttcaactttttgggcagcatcacgaccaaatgggaggagctcgatgccggcacactgaggagcttgatccaggacgatcaaggactggtgatgtctgaggtcttgcagttctatctcaaggctgtagtgagtggacgagtcatcaagcaacgcaacccagccatgtactggattgcagttcaccacctggcccgtgccgtttttggtcccatcaagatgccagggccgggacctccatcctcacgaggcagttcgcgtgctcctactgccccagcatcgtcagacgctgcggagcaagagggcgaactctcagccaaggagtcaaccgctttggaggagcggcggcgtattgtgaaggtgattgtggaaggagccaagaatgaggagctgcttcgcgactggatccaatacgacggtcgcaactatgagcggacagctttggcgatggcggcgttgacgaatacactgtctactctgacttcctcctcgccttccattgctccttcctcaggtcgcgatgtcgctcctgatcgaatcacgacgtcgacgtctgtcccagcgtcattgtcgggctctgttcctcagacacctacgtctcctctcacacggtcacccagccgccctctatcattgctctcgacgtcggcctccttcccagcgatgggcagttttgattatctcaactcggacaacattttgacgccacccgagtgcttccgggagcggcggcagctgatggtcaaggccaggaaggactggatccgagaagttgtaggcgagacggggctggagcgtgttgagaaagccattttggcgggggtgccgacgcctgtgggatcaggacatggccgtgcaccatcctcctctggatctggagcaccgatatatggaggcttgaggagatgagagaaccgtctctcggctcaaagtgtctgagagagcagtgtcagatattctttgtctgtagtcaccaagacaagagtcgtgaagaataagcactgcctttttcttttttttttggaccattatttgtatgcaaaagtgtgtgctctttatttttaaaatgcagctgtaaggcgggtaacaaaagaaagccttttgcttctaatgtatccttccttcctttgtcctggccaaatatgttttcttttaaatagtctgcttagagccggccagaggagcagatctgccgtgcgcgtatgaatatgtaggcggtggttgggggtaggggttgtttgggtatgcgagaagaaagaaaacttctggtttcacggtaggtgggatgctgactgaggcagcatgtgctctattcatatttcctcctccttgcacttcttcactctgtcttcctccgttctttctctctgcggttcggccgatgtctgtctttgttttttttttacatgtagtcgtatgtatttgtctgctggctaagactcgagggtggctggggagtgcctacccgcatggacggaggcagcctggtgctgttggaacgtgcgatcggggtcgggtgcgtcatggttggactggcgccgccgatgcgtgtccggctcgagctggcattgcttccggcgcggtgcatgcccatgccgccgtcgatgggcgagttggctctggagttacctccggaccccgaccggtccacctgacccggggtggctatccgtgagggcggctgttgagagttgttgctgttataagtggatgaggatccgttggggtgatcgagtcctcttgtaggcgtcgtggtcccgttcgtgcgccgacccgagttactcctcaggatgttgtttccgtcgtggaggtcattcttgggcatgcggctcgagttggttcgctggacaaacatgggctgctggtattggggctgaggtgaggaggatgctgcgctcgagaccgaggcctggcctgggtggtgctgttgatagcttggcttggggacctggggactgttgccgcctgcagcattgtagtgatagtcctcgacttggtccaagtagccagagtgtgagcttccggacgagtaatagggatcggtcgattcctggagcggtggacggctatagtcggtcatgtcctgattatcgtggtaatagccagggtcttgagcctgttgtccataggtgtccatctcgtagtttccaccggctccctgatgatggtggtggtggtctgctctggtggactttttcatgcctcctgtgcggctggtgcctgggtgactggcgctgttactctcgccaaagcgcacaccgagcccaccctgttggtggtccagctctcggtcttcgaacgaacgcccagcgccgttggcagccgcaatcttggtcttgacggcttcgttggcggccaggacgcctcctggtccaacgtctttcatcaatgcccgtttgctgatcgaagcctgcttgaacaaggcggcgtcactcagctcgttgtcccggcttgcagtggcccctccacgcttggaagaccctttgtcgccgggggtgacccggccagattccatgttgttgcgctgctgctgctgtcgaaactggcttcggtactgagcacgttgccaggtcgccgctccaaccgcggcaataaacaaaagcatgaaggcgctgtatatcaagatgcccgaggtcaggttgtaggccccaacgaccgaagggtggccgaacagcgcaaagtctcccttggcgttgttgacggggggcgttggggtcaaggtggaggccggggcggtggaggaaggggtggacatggtcgtcactgacttgacggagccgccgttgccgttgccgttgctgggggtgggtgtggaggtgggtgtcctgggtttggcgcttctgggtggtgggctggccgaggtggctgcaggattgggtgcctgacgcttctggagaaggatgtggttcagaggagatgaggcggtgggatcgagcgcgggcgatggggatgggcggtcctgtgcaggagtgtgcagtgcggacacgggcgggtggagtgtgacaagagcaagcgcaagggccggtgggggctgtggggcaggaaggacggacaggtcagcagcagcagccaggggcagacagcaggatgcgaggatggaggagaggatgaggatgcggatgaggacggggtggtgggatggcggtggacgatggggacgatgaggacgagcggagaggaaagacggagacaaggaggacgaggaaggcgaggaaggcgaggaaggcgaggaagacgagcaagacaaggaagacaaggaagacaaggaagacaaggaagacaaggacaaggacacagacggcgggaaggacaagagcggcaggcgagacaggcgagacaggcgagaccagagggacacgagagccaaggacgacgacgacagcacagaagacggagtcgcagcagcagcagcagcagcagcggactgcgacgagagggccagggacgaggaggacccggccaagggcgcaaagacggagagcggagccatcgctgtcgctgctgtcacaggtgtgtctgtggtcgcgggaggtggtgctgctggtcctgctgttggtcctgcggctgctatggcgaaggcgatggctatggcgatatcgcaaattgcacatccgatagttcagcagagacaaacgggaaattaatcgcctgcagcctgagccagatggccacccacaacccaatcaccctccaacccagcaaggaaaataaaaaacataaaaacacacaccgcaaccttaatcgccaaggttcgctgtgtctgtgtggtcgcactcaagaggcgacggccgggggcaccccttgtcctgccgcgcctctctgcccacaccccagcctcggccattcatcgccgctgcctctgctgcccctgctatcgctgctgtctcggctgtttctgctacgagggcgacgtcgacacctgtctgcgccccatcgccgggcctcgtctcgccctggaggcactcactcaccgtttcggtctaggaacatcaatcgccgcgagacagaaatagggaatgcgaaaaactaggcttgactacttttgaacaattccagaacacggcttggggcctacgagggcggctggacaactgtacaactctatttgcacaaccaatggggcacgtagcgtgcgttagatgcgtgaacgatccaggaaattaaaaaagcaggtgcggctgcattgtatcaacctctgtcagccgtctggcttgcgccatcaggcgcacgagtgggtgcgatcaaggagcgagcaaggttcaagaaagggtgctgcatggtgtggagaacgaacacaggcaaaagtcggcagaaaaaggtggacacaatatgaagataggagatgacgcgagtgacacttgtacaacgcatgtacccgtcggaaaaatatatccaagcaatgacggctgtcatgagccagaaataaacagcatgctcgtggcgtccctaaagtggactgatcggatgaacgggtgcaaccctgtgaggctgccgcccaaaggccatagaaagcgcgcttccttgcatcacaaaataaaccccccgtgggccacgacccgattctcgcacctacactgacacaaatgatttgtggtgtgtggtatatgacacagggaggctgtcaacaacaaggcagtacgtagccccccttgaagcagtgagtccgcgagccatgtttgctatctcgatgcggttacgccactgcgagcgcagcatcattgtccccctgcctgcctgcctgcctgcctgcctttctgcctgcctttctgcctgtctgcctgccttgcagtatcttcatatcatctacacactcacatagcagagtgaaaggagggttttttccccttgcctcttgcctcttgcatatcagcctcgtggactgaacccctggccaatggtgttgaagccatgatgctccctggaccccgtctgcccgccctgattggtgataatttttttccgcccaactttgtgcctgaagccacgaggctggaccgcggcatattttgatagtgatgaaacaggggtgaggacttgaccagcttgtttacctttacaggatagcaagacagcaacgcaacagtaggcaagaacgacggagcgggggagagaaacagagggcgtgctggaaggaccaggaggacggatgagtggatggagtgtggatgtaaatgagtaattgggcaaagatgatgaattgcacaacgtccagcactggctcacaaaaccttttttacttcggtgtcctgtataccctggatgcaaatagcccatcgtcgtcgtggctctctattctgcacttctctatcaatcgagttccctagtcgcatgatctgagtaaaattgcccgcggccttaaatacccagtctagttgtgccaagtgcatgcatactgttcatggccagcacattggactcgacatgatcgctctcacgatcgttcctgttctcgtccttgaggaacaaacacggattgacatcttttgcggttcttttatttcatgtgtgtcttactgacttttgccaccggacctggccacacaaaacaaacaaatacaaaatctgcgtttaccaggaactggtgaattcgtggcgggggtgtgctgagaggcaaaaaagaggggctgaatgacccaccgttattgtaaaattagtgtttgaatgtcagtggagtgagagccctcatccaatgctcatgatatagccggatgctcaatacatgtagtaattagctatacatacatgtacatgtagagttatacttgcaacacaacacctggcccaatttacacccagctcagcgtcttcatgccataagcaactcacagaatcagatctttctgcatagatgtcacagatcgtgtaaatgcaataattcttgctaatgatttgcgctgaaagttgtgcttttgaatggcttccatccccagcagggcctataaaactaaggcgacgccgtccaactcacacgagtcaattcgtatggttcgatctgatggtcgttccactcgatgtagatcgcctgccagctctcgcgctttttttgcgtcttgtggcagccgtgcactaggactatgccccgtagccaccatagcctacccgaacacccatgacagtatatgtagtagtgtatacatgttcagtacatgtacctgaccaaaaagttcgaaatgtcctatccgatcatggtaggacaatggaagcatcgcatgcttcatttgaaacctgaaacattttaatcgcgaatgtgcctgaggttcccagaacagcccaaacgtattctcacggtatcctatgctacgacaatgcaacaatgctcactgagggtcgacgcatgcaactgattcatcaaccttctcaaaaatcatgccactatacacaattcccttttacatactaaacccgtcgtgataggttacaaacatactgccctataccttcctacttgcactgcagagatttagtaacagtgcactcatcgcatcgtctagacctcctctcccgtttagatctttgagagtcgttgtcatttatttcagcaacattacaaatatgaagcaaagtaccgctcgtcctattgtgaccaagtccggatcaccaacggttttaccggatgcattgatattaattgcatcgaatcgacaggtcccgcaatgcgtgtcttatcatggccattttacattgcaagataacgcaagggtttgttagatgagcaatctcgacgtttgaaaaaaaccttggacaaacaaaaaaaaatcggcttaccgcctgttttggctaaattggcaccctgattgaatcatgaacgtgttagaaggcttcgcgacgtgagaacagaacagaatcatggcgatatgctgaaaaaaaaagaaagactttaccggaacgtagaggccaaattgcaagtcggaatatggtactagatgcccatttgtcgcgattccttgcttgccgatcatgggatcataaacgtgcctgaataaagtaaaaaaatcaatgtggtcagaacatcgttttcttttccacaaaagtctttcgtgcgttgcttcaactcttactaccgctgtgatgagatgcgccagaattgatggcagttgcacctacagcgtatacagtcctgtggataaatgttctttgacttttgcagtgtcccaacgggcagatgtcgctgagcccgatatattggctatgggccaaactctggatggatctgacaccagagccgcctcgagcgtgagtgaccgtggtgggacgagcagtgttttctggtcaaagacccattccaagtcgatgcggcttccaatggggaaaagcgacgggttcgcttgatttagttttggtttgaccaaggagagtcgactagcagggcttcgaggatcaatggtactagggcctgtttcactactaagactgtcattgtcgatagatgaagagttggaggatttgcctgctagagacggtgctggttgtgatattgatgacggtacttgggactggtggtgctctgagggaacttctgacatcgagttcggtgggtagagatactcatccgtcgtatcctgtttcaccggagtgctgaggagtggagccgactcttccgggtcctcgagctcatagtcatcgctttcatgatcaagagctatgagtcgtcatattgcagttctgtttagatatctcagattaatgtaagcagcagctggagcgtcctgtacagccacagtcttaccgcgacgatcaagcagctgtggatcggacgctgaaaccatagacaaagcaatgacgaacgctgctgccaagatgaataactgtcggcagcaacgcgaagagcgagacggagtcatgttgaccttttgaggtgtactggaggatgctcggggagtaaggaagaggatttttcaaaaacacacgaggggtttatcggataaagattctgaaccgacctgaagcccttcgcctgattccagatgtgcttgcaggcagtacattatcattctagttgtcgcgctggcactacagcttcccgaggaagtctccgaacctggcaggcggagtcttgctcgtgggacaatcgacttcgttcaactcaagcgctgacagagtgaacgaaaacaaacaagccaccgttttttttttttttgttcactactcttgcatgctcaggtgctctcgtctccattgcacacctctcctcttcccgcttctctctctgccgccagtcataaccgccatgggcaaggtcaagaacaccaaaaacaagcagaagcgccacaatgccacgggcatgcagactgaggctgaggtcgaggaggccgagagacttcaggcggtccctgctgagactgtcctgccgctgattaacaaggtaatggctttttcagtttcgtctcttgtctcttctcctttctacccgactcgaatatcgccgtctagttgcatcgacgagtgtgaaggcgggtaacagaactgaaaagcgaaagtgccgctgacgtaccctgcaacccgtacccttctcatagctctcctctcccgacgccaacgaacgtgcctgggctgctgcaggagcctccaacttgttgatgcacgatgctgccaccaggagattaatgctgagcaaaaacttgattggcgctttggtggatcgccttacggactcggtgcatgaagtcgttgtggaggctttgggggctcttcgtaatctgactgttgtcggaggtcaagaggtcatcaacgagatgtacaacaagaatgtgctgacgccagtgacagccctgatcccggctctcggaaacatgattgatactatgctgagcggaccagccacgagtggtcaggaacaggagaagagaaagactgtttgggattgggccgagaatgtgatcagcgtgatctgggccatgtgcgaaaactcagagaaggcactcaaggtcgtcaataagctgaacatcattccatttctcatgtcattcatgagcaacatcgacaaattgcctcccaaggtcattgttgctgctggtaagcgatccaaattctggtgttggtcaaaggtcattcttcgaaacagtttctcagtcaagcagcctttgttgacaaagtttcttgcttttatcgatctagctcaatgtctttacaccttgacggacgacaaccctgaatgtagggtcgtctttgtcaaaaaccccgactacatcaagcccttcatgaacattttgagtttgaacgtcaatgcagaggaggagctgttgatcaagactctggcctgcgggatcgtcatcaatctcaggagcgtcatttcgccaaagacttcggagagcaacttttccgagattcacagcgccgtgcttccggttttgagcagtgcactgaactacgacctccagaaggctagcgctgaggccactgcggctgcagaggttgttgtaagtgacagaaacggtcgttccttctcgagaccttgggtcgttgtatcgtaacatagagcttcacgactgactaatgcttctaccctgaactatagaacgcacagaagcaagactttgatttgtcaaaacctaatcagccttccacgaatgaagagcgtgcgttggccttgattgagacgcgtctgcagacactccaactttcgttggagttgattgccaacatctgcaccgagagcgttgagggtgccgagcacgaggaccaggaggaagaggaggagtggaaggacgaagctgccgatgatgatgagatggacgccgatgaggacgacgaaagcgacttgcaggaggatagcaagaaggacactggcttggatgaaaacaccctgcgggaaatggaacagttggccgcagcctcagcagagacgcctttggacctttccagtcacccaatcatcaacattctcaccaacacagtcttccctgcactcatcaacctcgggacaccaacacctctatcgttccccgcacaggagattcccacacctgcaacagccgcaccactcatcacagcccagttggccacaactcatttgcgggccattgaggcgttgaataatttcctattgacaatggccgatgcggttcctggaaaatggtggtacagtcaaaggagatcggacgctgagcagtgctggacgtggctctttcaacaggcgggtaatgtcgcaggaaaaggcgttcaggtcggagcagaggagaagggtcaggaaatgcgcggtacggttctggatgccattgtgggctgcttgtggaccctggcacgtggactggacgcgcaagtgcccttgagcgagttccatatcccagccctgatgggcgcgtacgcatctacaacgtccgatagcatgcgtgtcaaatccattgggtgcttgggagtcatcgcccgtcgtcaaggaagcgtcgagaacaataaggtacatgctctgccgtccaatggtcacatcacatagttgtcaagtaggacacacagcgctggagatgctaatgtttttgtgttttttttttggacctaggttattggagaatttttgatcaatctgctcaagaataacccaagcacagaggcgtgtatcgaggctttgaatgccatctacgatatttatgcagatgccgagtttgattacgacatgcccgtctacgtgcagggcaactttaatcaggagcttaagggcatggtcaagatggtgaagttcatggtccgcaatatcgatcgtcgcaagagtcgggatttgaggaaccgggctgatgaggcgtctatgaacttgatcgagtttgtcaagtacaaggagaaagagcgccgccagtgagaagggaggcgtcggtgggagaatatgaccagcatgaatgataatgggcgtttgtaatcaaataaacttttgcatccacatcgcctgctcttactgttatgctgctgccgtgttcttgcaaggaagactcacgattgcagcagccgcaactacaacatgcggcgggaaaggaggaacccccgtgggatgaatgcctacttcggatgacccgcgacgtgaagtacaccgacgcaaacgagagcgacacatgagcaaaggaaatcatggcctttcgcccagcgccgctgaatgctattggctggctcacaattcccaggaaccctctaattggcccatcaccaaaaacaacagcgtgcttggaggtgacacaaaaccaactcctccgtttttttgcatgagcgactccttccttcttggagggtgcaatcgatgagcatcaacggcattcaaaaggccattgcgcgagctacggcaaagtcgagacggaggtcctgagtagtacgaggactacggttattttttatccgccatttcaagcaagggaagcatctgatgaaccactgttcgcgcaggagtatagaccgagtaaaaacacaacatgcagcacagtactagcatccacttatactcacagaggtatttgccactggttaatcagtaatcatcatcgagagcttcccagggggcgtttcgggtttggatcgtttcgggtttggatcgtttctacaatcaaggtacgatttcgagtgctgcgattagtaacgatcataattgacgcttcagcaaaaaaagcaatgtacttgagtgtgctggagaagtgcctttcatcatccgtataaactatgagaaatctttcacggtgttggaaaaacctcccagattcaacagcgatgtgacgcacaccacgcgcatctattgttgtgctgttcttgttgtttagtgttttttttcttggcctaattgtgaggatcgcatggaagaaaacaatcacgcgcccatttccatcctccacaactctctcctgtgcaaagggaagatgttgtcgaagttgagacaactggttagctgctgcatgaaagcgaatcgttgatgaccatgcatagacgatagcgaagactacggtggcacaacaaaactcgaatagcacccggcggaagtggtgtggtggcaatgcacgcgtaaacttggatatcgaatcatggacggggagggtctagagcgctcccgcttagatccggccatcgattgaatgatgcaagtttaagtgaggcaaacgggccaagagcggctcttgtgctcaaaagcacttttctgcgtcatttcgatcaaagattggagacctgcgagttgcattgttcacctgaatatcacactggcatgacaataactcaaaacttgttcacaggaaggaagatgtcagggaaacggttgcgatcttatcgtcggtagatcaacgaagcagacttgacactcaaagaaaagttgacatttttgggatgtagtacaagtctagtacacgcagcctccttgtcccgggaccttttgtactttcgagtcgtaattcacgtccgcagagaaaaatcaaaagcgatagcatcgctgtccacagtcgacttaaattaagcggtatgggtagcacctcctttctgtctgcaactgcacagcgtgtacagtaacctttcggtctacgagatccgcgacactgtacagcacatctgagtagcataatatgaagataaatgttggctgccttttcgaaggacgcatacaagcaagaaatagcgcagtctcagttcatgggcacaccttgctttagcatttgaaggagaggtcctttaggaagaaaaggttggactgagagtgggagggaacagaggtgcacggtgttcgacttctgtacctagcgcgtgattaagcggaaggcaaggttgtcaacactagctctggccacaacaaaataccctgtatgcgatgggaagggaaggggacgcggcggcagggctgataggacggtacaggtcttctcacctgtgttctgtttacaagtcgttgatttacctcaccatggctcatgactcgctgactcaatcgtcctgtcttggcacactttcatagggctcctgtgggcacagatgccactcaattgatttaagaggcgattagcagaacgcgcttacttcataatcgcgatagatggaccgagagtccaacgcgacgctctttttacgcatcagagccatatcaaggcgccatggtgttttgacagacctggtaatggtccctgtcgcctattgctcggacacacggaacgtgcccacatggcagacacgctgctaaagtccgctcgatgagacaaaaaaaaaaaaaggccactgaaccccagggggtcgaatgcaaaaaaatcagggcaacagtgtgattggacatcgtgcaggacattcccatgaggatttcgctttggttctactctattgtcatttctctcgcggccactttctttgctgtttcctttcttcctcacctcgtcacccaccgcgtctttctgccgctccctctcttacttccttgctctgaccttcaccaccttcaccacccgcacgcacgcagcgcgccattcaccgccttgcagggcaattgttctcttcctactgtgcattctcaccaggagtgaacggaacagccgtgcagacctgttgcttctgcttccctgcaaccctgccgttctgaggctgccatcagtcccatccctcgccctctgaatccagtctctcgcccattcacttagcggcacagcaacatcagtgcacccgcaacggagcggaggatttgaacaccctcgttgtcactcttcgtcctcgagttcttgtttttcagcgatcactgccctcgcactccaacccctctcttgacccatcctctccactcctctccactcctcccattcctcggcagcaatgacagtctccaaggcttcaatgatcctcgagcggtccatcattccgatacattacaacctcaagatcgtcccatgtcccgtcaacttttcattcctcggtgaatgttctgtagagtaaggacggcccatctcactaagcactttcaagtgtttgctcacccacgcccgctttatcgtttccccgtcaactgcacgaagctacattcttccatagtctacgtgggcaacatgatctttttccttcaaaaggcgcagagacacgtgtgtgcagctacagtcgcagtgatgttacgcgcacacttgctgcaacagtgcagaggcaacctctgatttcctctttatctattctgctagaatctgcatcgctgagccgacctttggcatcactctgaatgcaaaggaactcaatatccaaacagctacagcaagggataatctgtcaccaacagaatacaggtgagtggggcagctgctcgtttttcttccccatgcgcgtcaagtgcctcctgcccccttcagcccgtcccatcctcctatccccccttggttattttcagtgatgtcgtttccggggtggttctgactacgtgagagcacctcttacatgggacagagagttaatggccttgaagtatgctctaatgatacaagaagttgattgagcattgaacgacgatctgcttgtcagccgttcaagtagtgagaagcgagggagggggtataggataaaaatgtgcagactcccgtggcgcgctatgaaaattatagagtgaaagagaaggcaggcagagtagcagcgataacagcttcggggaatgactgcaagacgagatgtgtaaacattttatttagccatcgcttccattgttggactcgtaccacgaaaattttttttacgcctttgccgcgctttgattgatccatgggctgaagagaaatagcgacaccgcacaaacattagcgtttgcaaacacagcgatttgtctccgccccctagtcttactcctgtgatccctatgcttcccagtgtttccagatgttggagagtcgaaggcagccattgcattttgagaccagtgcgcagtgcttgccagcgcacggaggcaggcgagttatgggcagagattattactctcaaacaacaattaccatccacaagagtgttctacaaacgactatatatcaacacgtgtgaatgagcagtcagcactatgatacccttgagctttccttgtcttgctgctccatacagggcccgattttgtatcaacctagggtgctaactatgtgatataatgtatcgaacaatggtttgccttgctttgcttaatgttctctagtgtgacggcaacaagcgtaagctacaacgtcgaggaagagacgatcacactcgagtttccacagatcctctacatcggcacctcctgggtgttggacatcgcttacattggacttgttaatgataagctaaacggcttctacagatccgtatacacagacgctgagaacaacgtgcagtaagtttgcttatacgcgtccgctaggtcctcaatcctcacactgttgtcagaaaaggctcaagtacgcgtgtctaaacgtatcttgtcctccaactctttatcttaactgcagtcaactgacaaccacccagttccagtccacacacgctcggagggcgtttccatgctgggatgaggtaggaaaaacctgattccgcgttgcgctacagcaacagtgtcagattgcggactcacgacgctctcaatgcatcaaacagcagctatatccgcctgcgcccttgtgttcacatggaaaatttcggtctctttatgcgctactccctccatccgatgcgcatattgactgacacagctacagcttgaggatgtatacgcgtataaggcttggcactaacttggggtgatgattatgtgatttgtgtttagcctgctatcaaggccaccttttcgctaacacttgtggcgccacaggaaatgacatgcttatcgaatatgagcatagagactaggactgttttggagaacggcatgcagcaggtcactttccttaagacacctatcatggctacatatgtaggactgcggcgagttttgcgatcacaatgctgccttttggtgatcagctagagagaatttgaaagaataatctaaccctcgcgtatctctggctcaatagctgttggcatggatgattggagactttgactacattgaaacttacacctctggagagttcaatggagagcctgttccgtgtcgtgtgtacacacctgtggggctttccacctacggacagtattctcttgatcttgccgtgaaggtatggcatcgctgcgggcttaaatgatagaagtatagtgatattggcggggtcttcttgaacacacgcggcgctgacagaatatgattctttgcaataattagtcggtcgaatatttttcacgactattcaatataccctatccgctacccaagctggacttggtggcggtgcccgacttctcgcctggtgccatggagaactgggggttgatcacgttccgtatgcatgctttactactcgccgaagacggtacaaatgaccgcaaacgagagattgcggcaactgtcattcatgaaatatctcaccaggtgagtaggtcaaacaaaaggaaccttttggtaacatttatcagcatctaacgcccttattctcatgtgctatcgcaaacatgtatagtggttcgggaacttggtgacaatggactggtggtcggatttatggctgtttgaggggttcgctacccatttagcctatattgtcgttgacgaactctttccgggctgggatatttggtccgagtttgtgaagcgcattcaggaagtcttgaagcatgatgcgcttcgaacttcgcatcctgtggaggttgacgttgccaatccgagcgagatcacgcagatctttgacgaagtctcgtatatgaagggtgcctccgttttgagaatgctgaacgcctggctaggccaagatcagttgctgaaaggcatacgcaagttcctcatgacatatatgtggggaaacgcgaatactgaggatctgtgggtcactttggccgaggagtgtggagtggacgtgcctggcttcatgcgcaagtggacaaggcagacaggagtaaggcgtcttttgcgcatgatctatcgctggcgaaatatattctacgtgtcgtttattgacaaaaacgcctctctctcagcaccctgttttatcagtcatagagcttgatgcctccaccattcttgttcgtcaaaatctctttctctcgaccggcgacgtacgagaggaagaagacacgcttctgtggcctgtgcccttggcactcgcaaccgctgatgacccgacaccccggaacatcatgatggatacaaaggagttgattctacacgtcgacactacccgatggtacaagtttaacatggggcaaaccggcttttatagggtgtcgtaccctccaaagacattggcactcctaggccagacgctgatatgcagaaaaatgagagacgtggagacgcttgatgcggctgatcgtgttggcttactgacggatgctgcagcgctcgtcgcaagcggcaatgcgccaacgagtagtttcttaacgctacttaaatactttgaggacgaggagaattacatgtaagtccatcatcctattgtttcttgcaatgttggcgcagtgtctgatcacatcatgattttttctcattaacacgaaaatttcacatgggccgctagggtgtgggtcgaaatctcgctcaagctacaggagctcttttcggtatggctagagcagcctacgccgatcatgaatgccctcaaggaggtccagcgtaggctttttacaaagattgtgaagcggctgggatgggcctacccagagggggaagaccctcttgtgggaaacttgcgagctctggcaatccgatatgctggacgtgccggcgatccagtgtaagaattttttgtgcgccaaggttaccagtggtgctacgtcggagcatgtaaaacaaaaatatgcgattaacacggcccttttgactttcagtattgttaccgaagcccagagacgattccgaattttcatgaaggagcgcgatatgtccgccatccctccggatttgcggttcccagtttttgagatcgtgttgcgctcaacaactggcgtggaggagtacgaagctatcgtagagtactaccgagagacgtacatgcctgatgagaaggtggtggcattaaccgttttggggtatggtcacacctctgaacttatcagccgaactctcgcatttgccatgtcgcccgaggtcaggactcaggacattctgaccgccatcgccactctgcggtcttccgtatctggccgcgctgagctttgggacttcatgaggcatcactgggatattttggtcgagcggcactgtgacgacattcggttcctggactactttgttctgctgagcatagggtcgttctcaagcattgagaggtatcgggaggtacaggaattctttgccaacaaggacaccagtttatacgagcgtcatctagcaacctgcctggagggaatacgaatgcatattctatggctggaaagagatcgacaggatgttgagcagtggttgcgcgcgaatggatatctggaccctaacttgggcccttacgacttcccaccccagcaacagcagcaaacagaggggtcaaatgatatggaccaggatcaggaacacgggcatgactcacacgacattatactcggcaatgttgacacccgcgaccatagtggcgcccagaatcagcactaccctctaattggacgcgatcgtgctttatcagctctgggaaggagcagaagcagcagttcggctgaggagttttcctcctcggccaccattaacactttggtatctagttcctcagcgagttcctcctgctcctcctctcctccaaaggtttatattccgccgcgccaatgccaacatcaccagcaccagggtcagcacggcgtagaacaaacggacgagcaatctcaacacgacgagcagctcatgcgttcgcggcagtatttggctaaccctgcgcttctgagcgaggagcatttccagatgttggaactacaacaacagcaacaaacgcaggaggcacagcaacagaagaaggctcagcgagagaagaatgcttcctgtccaacgagcatgggaacagactgcagtctcggagtcaatactcttcagaacatcaataacttcatgttgctctccgccgcaacagctgtagctgcacctcagcctcaaacgcgacctcatacactcgagggagagatggagctactgcgtgtcagctcagacgacaacttttgatcgattaccgaggaaggggagcaggtcgtagggggtagggaggcttaaataaatgcagaggttgtgaagacctacaaatttgagacgtttttgcgcttcaaagtgcgtttgaaaggcatcgcttctcccgagcggtccttcagcgcctcgcattcggtggcgagggttgaatatacggcatcctttacgcgcagaatttcttgtaggatcagcgggatgccgccggagtcgctggtgcggctggacggaccatggtagaataatcgtcggcgctcagcagagcaaagacacgctctgcgaggcacttcaatctttacttctgacagcttgaccgaggcggtgcagggagtagtcggcattgatgcattcgatagcaacacgcaatatccgacaccttgatccggtcacccttagccctccatcggtcagtcgtgtgccactcaaacacgtcgatgcccctgtcgatgaaacgcgcgtaataaaaatgtgtgggaagaaaatgaacataaaccccttacctctttcctgctcagctcgctgaccagggtcgtcgttcgcgtctccttcaccagtccctcgacatgcaagttcaacgcttccgatggaaagacacagtcgaggtcatcgaggtgcgcaaggatgccagcggccgacactacagcctcatcgaggatgtgcaagacttgtttgatggggcgttccgattcaagatcaatggagtcagcatcttgttcctgcaggatgagactggaaaaaggtagttgagcgtactaaggataagtgcgtgcgcacgcttatagcgccagaccgggaacatcagctaactatgtttctcaggtacgagcccaggcggataggccactacccagataatatcattgacgtgattaccgttcacgaccagcaaaaagctgcctattccatcccgcgtggagagcagctgccttcaaaccaggaaccatcgcgttcggatcaagaaccatcgcgctctggccaagacactgttgacgcccgcatagaggagctcgccataacccaagtttctcccaagagtcccgctctcgtccaagcttcagcagcaccgccaaccaccccgctggggggcgctttgtcgtcatgttcgtcgccgtcgccatcgttgtctggcgatgagtcaacctcaatactggcctcggcgaggaagtcatcgccaataacaacaatcgcggcaaacgcaccaaccagccactcagcaactctttcctccgttcgctcgacctcgtctgaaagtacccaggcaacttccgacttgcagctacaaccggagcattcgaacgatgaacaatccgcccatcagcacgcccaggtcatggcgcgtttcgacgaggtgctgcagcggcagcagcagacaaatgatcgactcgaagtttagcaacagacggcggatgcgatccttgtccaaaattacgagttacacgagtacccgattccgcggctttttgtcattctaccagagagcatcaacccctaccagattgaggatggctctaccgcttcaccgggagaagagccatcgggtttcctggaaaaggcctggaactgggatccctgaagcttggtcgaggagagatttaaactttactttctgtgtgagtgcggagaatattctagggcagacgccgatatgaccacttcgactacaaagcctcccattcgtagtcacggccatgctcagggacggcattcagcaacctcgctcactggtcagctggaaaatcgagttcatgtcgcaaaacatgagggctacgagctgtcaagacctacccaattctttgaacagtacggcccgtatgttctagggatgcttcaaatcctaaagtattgcatgacagcggccgcgttcgtgtctcccatcgtgggactatgccaaagtgacatggacaagctggcagaaggtgtcaaggcgataaatgacagttctttggaggccatcaacgtctcaatcgatttcttggagcacaagctcggtctagacagcggttcggcaaacgacttcagcaacagaagtagcggaggcatcgcagggattctcaagaagatggaaatcctcgagggagctgatctaaggcgactggagacctacttgcgaaacaaggacaaggacaagattttggggaacctgtacagggtcaccactagcgacggccatgtcaaatgggtctgcttagagcacggtcgcatctcctaccttgaggtttccatgaagaattttctacgcacgcttgaagttaaccacgggcattacgacagtcatctccgcagggtgaccatcagtctaacctcgtcgagcgccaccaagaacttcatgaaccaacttggtagcaaagcccctggagtcaacgaactggaactaacactggactgggaattcgactcttcggacctaagcaaaattgtcagcaacctggagcattcaaacgtcaggattttgaagctcgatttgaaggatgtccagagacggtccaggatcgacgtcaaactgccaggaaaaggcagatacaacccactgcttgaggttttggcaaatccaaagatcaggtctctatcgttgagaggcatggaatactttggctcgcgcacctcgagcctaccacggacactggatgccagcaagcttcgaagcttccatcttgacacggtcaaggcctcagaccagctgcgattggcggaaattctcctacgctgccccaacctcgtggatctaagactggggctgaactactcgtcggatcaacaggaagatcttggcctggccgtgggaagtctcaagcgcttagaagtgctgcaacttcttgggctttcggatgatccggaagggagcgtttgggatcacttgcctgtagtgtcggctactacgggtcatttgagggaattggtgcttgtgaacatccaccagaggccaaccgagctttcagagagtgttcaggtgttcaagaacacgcttgaggtcttgatcgtcgaccctcatctgacaggcctcgaactagttcctcccgatggtgcggcattaacacctgctctgggggtcaaaccagccatgtggtccaagttgactcaacttcaactaacctcgtcggtttcggacacaacaaaaaggctgcttcactcaattctgccccagctatgcctcacccatttgggactcagtaaggaccttggaagcctcctgcaaatcatcaacttttctccgctacgctctgtctatctttatgcagtcgaagtggcagacctcggcccactgtggaaggctttcccagaaaacggaggatcgtcccaaatcgagtccctttcgctgcagctcattgcgctgcatgacggcctgacaagatagctgaggacgctacacctaaaacgactttggttgggacggatgaggactgattatcaagaaccggaacttgtacaaagctttgactcccgccgacgattcccgctgctcgacagtgatagtgaggccgatacggacgactcgcgcacgatggccatctcccgccagtctcagcgcaacttgacggatttactcaatagcttagagctctccaacctcgaggtgcttgcgcttttcgactctgcgccagcggccttggaaagggtcctgacgaagaggcgagacgagttctcggaccatttgacgatacacatgatagaagatccgcccgaagaacccgcaatgttctcggccaaaatggccagcgctaggagcaaagacccaagactttcgagcaagaaatcctcccgagctgctgaacgcgtagcagcgacgccactcgacccacagcgcttcaagacttactcacgcgcagaggccgcgctgctacagcatcggctcatgctgtaccggtcgcaaacgcaatagtgacaggtttttcggaggcttggcttccagcaaatacacataatacatgtttgaactttggacctcgggaggacatcggccgccctttccgctccctatcgtcgtcttccatgctctccagaaagtctctcttgtcgagtgcagtcgctactctccggccagcagcttcctactttagcctgcaaagcaggaccttgtcggccgcggctctgcatcagtcgcaggacaagctcagcgagttcttgaccactgccgacaatgtcgatgttgagacaatgaccatccagcccgccagcggtgacatcactcaggacaggaagaccccttaccacaccgcgcgctacctcctcgagctctccgagcgtgaaaagaaacagtcggtgcgccgtcagaacaggaatagctcttttgcctcggagggcgaaacggaaaactcgacctcccgttcagctaccattcgtcctcgtcacttcaaaaatagcaacaacacaggcaaaggtggtgataggaacagcaggccggctgtgagattccaagcacctgccagcatcccttacgatactcgcaaggaactgcagttccctgaaaaggtcgactgggaagtttcctccgtatttgaatcgcgccccctctacgccaacgttgccgcagggcgtggaactgttgcacctctcggaatcaacaacaccaacaacaccaacaatgtcgtcggaaccctcttgccaggcacagccttctcagcccatgtctctggcgtgcggtgctatggcgactttgatcccgaggtggagcagcgcttgattcaggagttggcaccgatccaggagtcaaaggacaaggatcatcgcaaggcatcggatgtctctgccgagaaccaaaagtttctgcttcatcaactgagcagcaactttcaggagattatgaaccccaggaacgacatcaaccgtttcaacaatggaaacgtgaagcacacggctgacatccagtacgttgcgggctcggatgaggttcaagcaacaggtgatcagcaaatggaaaagtcgtggaagcgcttggaacgtctcggaggagattacagccgtgcaagttcccccctgtcgttgctcaacgtcaaacgtcatggcgagaagggccagatcctccttgaggacgttagccaactgatcggtcaaaatcagagcattgggttggaggataagaagaagttcatgaaggcagtggaaaagaacttgagcggatattagataattcacataaaacgcatgtgcgattttacgacacagaagcgctacttgctctcattttccttgttgctgtttccctattgttgataatgacactttatttctgttcagtcttcttcatcgtcatcttcgctaccaaattctgttcctttcgcgaccgcacccctaagaaaaatgaagcaggaaagaaatgttcgtactttgttagattattaggagaggaaatgcgcacaccttgccacagggtctcaagtaaatattccacatactttttcatccttgggttgagcgcactagcacctttgcgcttcttgaacatctgcgcattggctagcatcaccatctgcgcctttgatttgggacgtccacccgtggctcctagaccgccgctcgacactgcagggtgtacccgtaacataaaaccgtcgatgagcattttcatacgcttgattgaaaagacatacgatctagtccgagaccaaaccggctgggacttactgcgtcctgatttgagggcattggcgtgtaatcgttcaatttcccgtttgagctctgcattttcggtcttgagagtatcccgctccagcctcaaatcatcatagctcttgacccgtcccgcaactgcagtgttgtcctcttggtttcctgcattagtctttgcactcgaattcaatcctgtgaatgaccgtacagcctttggatccagggtacatccgtgtgcctgaaaatatgtcgcgcactatgaataatggcggacgcaatcggttagccatacaggacaaacgacctagttcatcaacctcacgaagcacccagctctgcttctgcttcccgaagagcttacttcaaacaggaactctcctatcttgtccccacgagtagcgtgattgacgacgtgcatttcaatgtcgatcgtctctagtttactggaggcgcttccagatcgggagtgaatctcattgtccacaacaactttgcactcgcgcgagctcatatccacgatgtgaaagtaaccttccagcacggcttccttgaatcgattcgcaaacgaggtccagtccttgtcacccgtcgcgatcagctttcgccataggccatggtatcaattttagtactgtgcgcaggcactggggcagaggcagtcggcggactgatggcatacaaggcacaagcggctccccttaccaggtcctcgagatcctcgcgcctgtattcccgctcaaagtaggtcttgcctgtgaaggcgctcagaacccagcctccggcctggtcttcgtcgacggtgtcatccttcgccagctggacctgagagtaaaagatggccttgcccgtcgtggaatgagtcagttgaacaagctgatgcagttcgaataggggctggtactttgtcatgttccaatggtctgttgtgtgaggggtaatgcaatgagaaggcgatggggaggcaggacaagccgaatggtttacggcgaaacaataaagcagcacttccgacttcggtgcaattttgggaagctgtgccgaaaaaaaaattgactgctcacgcacaatcaacttccaaggaggggccactttggcatctgtgtggaggggcgtggcagtcgcttggcacaggagataaccagctcaggctggcctgtgtttgggcctcgggaaacagcactcaaaagacataccgccaccacgtcggtccttgtccccggccccttcaaaagaaggctcaagagggtcgcatgctgttcctcaagatccaggagcaaggtcgcgccagctgcggttgcacaggttcgcagctcttttgaacatcctcgttctcctcggagactgcagtggagtattccaaccgactgcatatcgagcttcgaatttactcagttctggagtcagtgttatccaacttctagcagaaagtgttcaatgggctttacttttattttgttctaaagtgtaaaagaaaaagaaaaaggcggcagaaaacagggcgaaagcaagctaataaaggaggaagaatacttacaatggtatagaagaaagagagaaaaaatagattctaggctagatgtacaaagcaagctgaggtattaaagttgaaggagtgtgcaaaagaaatgaatgaagcaagaaaagcaggacgagcaaacaaacaataaagaacaatagaaaagggcagatcggtattaatggtttgcttgagggatacgtctgaagagttgaggatgagcagaaaaaaaaaaaagagagagaaaacaagaacaaaaacaagaaataaagtatcaaaatgaggcgggtgccagaaggtctccctttcctcatgctctcttgctctttcctctacttggatcgagcaggaggcaattcaccagagatggaggccctcataccacgagggcgacccatctctgccgcagaacctgctgcggccgaggaacccgccacggttacggcgctggcgggcttgggtgtcgacataagcggaaggcgctttttgggtaactccacgcagacacgacgcttcttaacgttgtctctgcaagcttcgtcgcagaaccagggtttgtccgaggacgcaatctcgtccgaaatgacggtctcgccatggcacttttgatggaaagcctttgggcaaccttcgcagcggaccatgacattgcctgggcaagagtcctgtgactgacagccatggcagactgagcaaacgaaaaagaaatggaagcggatgataagtagactggacaggtgatgctgagggtgtattctgtgagcattcaagagagacaaacttacagtgctgaagaacagggcggatacgttgctcaacagtttcgtggacgtagctggtcaagtcaagacgtggcaacttgcaagcaaatccataccccttgaagtcacagccgtgtttgttacacaacgtacgcttgccccatgggccaggacgccagttcacgccctcagttgtgccacaataacgacaccagtcaatgttggctttggtcaggatctggaacagtgtgggcgtcttggaatttcttgcgtcgcaagccttcttggaggcagaaacacgaggggcagtgacggagggcgtggggatagtggagctgatcgttctctcggcgttgaatgacgactgctcctgctccttcttatgggactgtgactcttgtgcttgagtactcctcactttgcactttggagccgacttttcaaggtcctctaggctagggccgtgccacgtaccacgacgtctgcacgtggtgaaggacaagtcgatttgttagagtcagagtttgaactacaaaatctcccgtcttgaatcttataagtgaaactgttctttacctgaccgggaactgatagtcctcgacatccgagaggtcagagtcactgtcgtcgctcgagctcatagcatcgatttgcatctcgttctcgcaatgatagccaatctcggcctcctcctcagaggatgaataatgatcctcaaaataggcattgtgaccaggttcctgctcggcctcgaccacaaacaggtcggagaccgcggctacggcgacaacgtccttgacctcactcgtcactcgctcctcatcatcctcttcctcatcatcctcgtcatccgagcggtccaattctggatgataatcatactcctcgtgcgtagggggcgcaaagcacacaatctctggcattgaaggggatgtgggcgtgaggtggcgaacgttacgcatctggaagagcgagcgtctacgcgctgtgaacgaactggcggaagaatcggcatcgctgagctcagcaacctcgtcatcaccagcattggatgctgggggagaggcgggagcctcagagctgcatgaggacatcatgtcgacagagagcatcctgcgacgcttagtcgaggagataccaccgagtagaaacgcgtcagagttacgaagaaagtcgtaggaatgcttgcgggcattaatctcagggggtgttggtaagctggccatggtggcaaagtcgcggggatcacagattgagactgggatgaacataggtctcttcatatccacgaccatattcgtggcatctacagagccaagatttagcgtaatcaatcgccagcgaggatattattagtcgcatatactacaaaagcaactagggggggggggggcggaacagaaataaaggaaacaaagacaaggggggaatgatggtatgagaacggcaagacgcattggaagggcagggagacataacgaaagtgcaggagacggaaaagcaaacaattgacggagtggcagcgaagatagagagtgggcatacaataaaaaaaaatccagcgcggcggggtaaccaaaaatcgagaacacacaggcgtattcaaacattgaaaatatatgggcgaggtggggaaaaaagagccagtagggcaagggcagcgaatgattggcgcctgggagagtggggtgtgacaagagaaaatccaaaattaccatcggtttctgagagacttgcttccgagtgaccctcctgctcggggaggtcagactgctcgtcctcggtgtcgttctccataaacggagacatgggagtcataggggtagagaagcaatcttggtgctcttctgcttgctgcgatggtgtactgaaccccgagtcagactcgctatcgaagctgctgtacagttcagtgtcgtcgtacagcatggtcgaagaaaggaagacgtcgttgataacattcttgggctggacagagccgtcgaaggagatggtgggctgtgtggcgttcgagtatactacagagggtgtggcgaggtccttggcaagggcccccgtcgcagcagcggcgactggtgaggctgatggggctggtgcgacaatattggcccaggggttgatactatcattcaaggacatggctggtgacggaagcggtgaggctatcgtcgctgcagctgcagcaaaatgatggtgatggtggtatgcaatattgcctttagacatcatgatgcttgctgtgtatctgtgtggtgtctgtgtagggagcgtcgggttacaagggagagagtaaagaagtgtggaccagacaagcaagcgaccgataaaaagtgagcgcacgcgcgggtaacgggaggtgagcaaggagaaggggggaggatagcttggatctgggatatagtgctattttacgagacgtaaagggagggatgaacaccagttctcagaaaaaagggccgcaagaatcagagaagggcaggtgaggagcacgagggagagggatgggggtgagatagcgataaaaggatgaagagaagagaggaaagaagcgagaaatgaaaaatgaagggcgaaagtgcacttgattcttgggcgagacgacatgaggcactggtcgcgacccacttttcttatttctaccctcattccctcataccactgttcatacgagctgatcgttatgaaattcgctctttgccaaccaggaacgagcaaaccttctggccaggaggaaaactctagtaagaagggggcacactaagaaaacccaaagtgccattgttttgatgtacgcacattgaattgcggcaaggctgttctgaggattcaattgggctttgtaataggccgttgtaatcctatttttgtgatagataagatattacccatttcaatcgagtactttaaagacacagagttgtaagcgtttgattggctagtcgagtattggaactgatcactccgtacgtgataaatatgggagatggagagtggcccatacctccttccttcaccactgggcttacgtccatctctctaaacaaaagcggccttgggcataagccggccgcaacgatgatggcagggacagtgaggagagacgagcgagatgtcgctgaggatctagttaacaatacgaggctatgactcaagcttcatactggaggggtagaaaaataatcgaatagggcaaggagttgctgcctcctgcgagttcccatgttgacttcccctttgccttgtcgctgcagcagatacatcatgagcggcagtcatggcatttaggcttacttatacctgcaacatgtcgatcctcgttacactctcgatcatcttccacttgacctcaattcattagacaagcactggcgatgtctagtgccgtgatcggaatcgttaatcaaaagtaggtcagtgaaattctttcacaggtggcgctgtcgaggagctggtgtccatctctgacacgctgaagctcgtctgcagatgaaatggccctccgctttacctgggacctattgcgctaccctgctcctgcgtcaacctaggactgaccctagcggtgcgcgcgctatcatctacacagtacaaccagaaagctactcgcgcatgatcccaacacatatagggactacagctcttgctcctggaggctggttttattcgaagatgcgtagtcgcgcccaaatctccccgccataacttcgttaaagtactctaatatcagactcagaacacgaatagaagtaactggtgctataaaatgaaaagagcaagggcatggatagagcagcattgacgtgggttcaaatgtcagtgagcaagctcagcaagcaaatatctgtgatacaaattactgttgtcggggaaaacaacgaggagtgcaacaggcagcaacatggatgcacggatgcctggtgcacccttggtaggcaacacctcatgatatggtcgattcgtacctccgagaagcgcttccaccctctttgaaggtttcacctggtctcgcacaccttccccccccccccccctccccctttcataatgatttatctttggccccccattccaatgacgctatcgctttagcgagctgacacgacctccttttttcttgcgcttgttgtggtgccaacccgtccaactgtgcagtcatgcgcagatcgtatttaaatatcgcgcattgtctggtttttggaggtgccttaaacgtgcgctggtcctggtcttcgcgtgtacacaatattaacgcaaacacgacgctaagatggtgcctaagagtcttggagggactcaattttaccttccaccaactttctccccgcgcccgcaacctcgttatgtagatggtagagcctcaacgagcagcgtgttaatggtaactgatttcaatgaagcgatcatcgatagccagcaacacttctcccatgcaaaatattgcctagacagcgaacctgctggcgttatcggaatgacattgtgtacacttacgacaaggtcaatgtagcactagccatgagattggcagattggcactccaccaactgttaatgggagagggtgtaacacaagcataagcacaaggtgaacggctttggtgcatagcacatgatttttgacccacttctatgaagttctagcattgagaacgcctctaatggatcattgccacacttgaaatgtcgaaagttacagagcagtggcgggtactgagctaccgactgggcatctggactggtatataaacacactgtacatagacctgaatggcccgacgttatgaggaactgcagcccctttagatttgatgtcaaggcgagtaacaataaaaaaaaactctcacgcgaaacaaagatgcgagtggtactcgggctcagaactctcaattcctccccctgcgatttagtatttcaaactggtttacattttgccgttcaggtgtctgtcggcaagcagctccctaatccactgctgtaaccgttactttcagtaggtgtctatcgggcgagctttggccctcatgttacatacgagaccaggccccaacggagtagcaactgcgacatggtcagaagggagacctccaatccataatgatacgtctccttgtttctctcaacgtatgtactcagatgcgaatggcgttgaggtgacgcctagagtaagtatcactggagcgtcacctcggaagccagaaaggtgtgagactgcaaccctcttcaggtagtgccgcgagactggaccgaattaaagatagcctatatttggcggaagtatttagggcgatgtcgttgcaaagtaagcaagaagcttccatggcgaagtggttgaaatgcctggtgaactgtgtcataccaagaatgggcttgattcatgcacggtaccattataacggttagacatgatcagcggttggctttctgcgcgccgacatccgcaagcaaacacataaaccagcctgaagaccaagacgagtccagaatcgcgacatcgggcactgtgcagagatgaagtcagtccgcgactatatccgcgctgtccagacaccctcaaagtattttcttgtacgggtcgatattctctgggcaaagctctcatgtttataactaacaacatacggctcgaatctggccctgctctttgggcactggacctccattgtccccacattagggtagaggagattgtttatcacctgcgggtcactctcaaggccatttgaaccgtcgaggtcagttttaggttcgcttctgttgtgcatcctggcttctcttgcacacaaagaaattttgtggacatttcagaagcaaatccttcagatacatcgtctcctcgtaactactacagctgttgccacgaaccaaggggcgagtgcatgtgcgagtccagcactgttcctaatcgctaaagtcgagccaatctatgtcttcgcttagatctgcctccatttgatgatgccagtacatgtacaataaaaggtctaaaatgaatcttgatacaccacaagctcatacggagactgaacctgctgtacttcacaatcctatcatgaggcgcgtacagcagttttcattgggcttgaccagcatctctcacaaattgatcagccaaccatctcttccatagaaaatctatgaaggatatcccggaccatcatcgctatcgccgtgcttcaatagtttgccacagatgtgcacgttgcgagagtaaaaacgtggcattagccatctccgaggtcaaggctctcgctcaagatcgagtgcttgcttgttgtcgattgtgtatagaatgcctcgggcataactcctcccagcagccgtaaatatagcaaacctgcatccaaggccgtccggaacgtgcaggcgtatgcacaggacgctacacatgaatgaacgggaaagtatggccgcccttgctgcatcactaattttagtatgtttttgcggtcctcgattccttttctgactccgctagagtccatgggttatcaggtcgcggccgttggcagagtaacccttgtgagaggagaggttcaaaaaggctctcagattgcgcctctttgccgtgggactttttggtgtcatcttcaggtcctggagacccgtccctcaagcatgcgggccctacattgtgatcaatgaaaagtatcaaggagataaatgtgttgacgaggaaagagggcttcagtgcaccctctgtcacgccacaatgtaccgatcttttatgcccctgtccagtagcagtgtgaaaaagtcttgataaagtctttattgaggggtgtatgacggccgttcgcactgacatctcttcgatcgcatacagacaaggcaaagcgggttccaaagtggcccgactccatgcaacgtatattgctttgttaacaagggcgacaacagacggatttgcaattattttttttgcttgcctcaaatggtttgtttgttttgagcaaggcatgaactcacagcggtactagtttgacaccagtgcaaactacatggcggcatcgaccccttccacgggcattgggcctcaacccgagttatttttccgtcctctcccgcgcatgcagtcaaggcaggggcaagtgcatgttttctgagcggatgttgtaggtctttggcacatatgcaacggttcttttttctgtatatatatttcactgacacccgtcactatgcgatcgaaggatccaagtatcattgctggacgtgcacgaactacttggtcgacaccaatggagaatagacttccaccccgttgcccacactctctccaagctctgtaaggttcacccctctccactccacatttgggttttcacgtacgtacactgtgatggtacatctggacgtgttgccatggccatggagtctaactttgttcacactcctgtttaaagtttacaggccagcagctgcatttacgagtgttctgctagacctcgaacctcatctctcgcagggttcactatagctccctaagttttacgtagttctttattcccatttgccaacaatggccatgacagctgcgccggtccacaaagcggcaaactgaactgcttggtgccatgtactttttgccctgaaagccctgttcgcgttcaactctgcccacatcagctggaccatggctgtatacatcaaaatacccgctgagcaggcatcgaatactccttgaattatgagggcttttggatacatttcttgataagacccacgaatcccaattcctattgctatgccaagcggagtgctgcacatgaaccaagtcgagagtaaccacggtctaagtgacgacctgtcaaagtcaagaactgagatacgcccaccaagagctaccccttcaaagaactggtgaaagagtagcgcagtgagaagagagatggacttgggtgtgtcgggaatggtgcccaaagtgatgccgatgatgatagagtgcagtgcaatgccaaactcgagaatataggtgcctacgagccgggatcgtcttgcttgttcaagaactatatcttgcggttcgatcaaagtcatagtaggagacccatcgccggcgactgcacgagtgtctatacccgtgtggtccataccaactgcagcatcgatattaggatcctctacatgcaatcctccattactgtaccctcctgattccaagatgggaggaagaacaacctttggcgtgcatttgctgaccagcaatatttctccgtttgaataatggaggaaagaatcgttatcgctcagactgtgaataagacccattcgccttgggatgtgtgggtataacgccggacatgatgcgtcgacgtttctgccgctgtttatggtgaaaaatgggtttcggcgctcgtcctcaagactgtcggccccgccaaggattccattgcaaattgaggacgtgacatcaccggcggtaccataaacctgctccatccgctcaatagggataaaagaacgacgagatctctgtcggtcagctgaaggtgttgccagtgtttctgctgactggcctcgataaagtcgcctccattcagaaacgtgacctgactttggttttttctccgttttggcagctcttgattgaacagagtcttgatcacaaaggactgaagagtgttgccggtcctcgtcctggatacaatgctctgattgcgcctttggtgtagttgactgttgctggcgcatgagcctctcatggagaacttcctgctccttgcggaacaggtgttgcgtggccaaaaattccacaaagtgcagggataatgcagcagccatcgcaatcataccggtccagccggtgtagccttccttatgaaacaaccatggtaggctcgggtctgacagactggcagaggctgaaggcagcatatgaataaatgcagtcgagatgataacgcctgatccaaatgttctcgcagccgtcacgacttcctgtcagaggaggataggtgttggtaagcaccggatagcacaagatatcaggcaaagcgagtaggtgcagtagcgaccacctttatggttctataaaagcgtacctgtatacaggaagtggtgctggccttgaaggaggtcatgctgaagagaatcggtaacagaactgagggcacaaaaggcttgattgttattgtgcctgcacatacgggacatcgttattggtatgattgaggagtgacttatgcatacctccgagaccgctaacagccattgtagcaaagacggctccaacgtgtacgggtatattataatgaacgctagaggccgagtagctctccgacatctttttttcctactagcgaacaaacggtgttttgagcaataaatggtgctgcactgacaattaaaggatcctgtactggatgggcgccagaatgacagaaatgctcaagatatatacggaaaggaagcgatagcctagaccaccctacgttctgcgccatcacaggacgtcctcccttcgcgctcaagccaggtaaagtctgcgaactatgcgtgcagatcgtgtggggaggtttctgctgcattatttttgtttcatttaaactcgctctcggcgaatgccattttgctgcttcaccgccgttttttgttcattattggccattacgacaagactgaagaaagagataaccgcacggccaatcacaaacttgacgacaaaaagtctccatcgacctgaatctcattgggatctccgcggagaaagcaggttgggatgacgacaagcaccatgtcaagtagcctcgcgctcaaaccaacgacgtatttcgctcgtcagtaccccagtcaagagcagcgaaaaggcaagtaggaacggcctggatccctccggcttactaacgtacactagcttgctcaatgtgacagacggcacgtcaatcttagaaacgtccaatatgtgaatcaggatgctggtatctggtgcgattccacggattgcccgatcagccgaaacactcttcagaggcagcaatgaagcctaagtggccgctttgcatagtcgcaaaacatcttgtcgtggacttgcaagtcaaagggcgatatagacaacctttactatagagaagggtgaaaggcgatggaaaagttcagttcctccaaggggctgatatggaggacatgttcatcagtgcggcgggagaaaattcatgtgggatgcgtcgagcaaccgactgttgaggccagtcctaactttcaagtaccccttcaaaatattgttcgcgtaccccttcaaaatattgttcgctcttgcgtgaggcaacgatttcaccagagatgctggtcctttgagacgcaagtctgctggaagagagtgatggagggcagagacatctgatgagagagtgatgaagtttttaaatcagctttcgcgggaggcattcgccatttacaatgttctggagcgaaatgagaaactgtatttttttctgtgcttagagtgcaaacacgacggccagtatcagggcagcagtagcagtcttgactccattcatcgaaaccaagcatcctacgttcgagggcgcagttccgcctggcgaggttgtcgagggtgcagttcctacattcttgcactgggacgtgtcgaaggaaggggcggaggagaccagaatgacatccgcacactggtagagcgggctgtcgccaccgttgtagatgatttggatggtcgcattagtgttgtcggcggcgcctttgaaggtggataggtccaaaggaaggcaggagttcccaggattcttgatcgagagagagcttgcaggtgtggcgccggcagatgtgaaatcggcagccgcgggattgttgccatacaccacgttcactttgatatcagcggtgacatggccgctgttgatctgaaggaagcctttggctgatgtgccggtgatcgaatacagtagttagcaggagcgttgctcactggcacgatagtaaagcattgtgatttatcatggaggccttactgagagggaactgggtgcggttggccgcactgttgaagcccccacacggcgcttgaggctcgttgtcatcgctgaatccccgcgaggtggggtagtccaaagtgaagtgggccatagcagcagagctgcagagaagcgcagtggcaagctggaggatcttcatgatgagggtaaatgatgggctgaagaaatgaatggagaaaagtgcatacagcagtttttttatacttgtgcgattgggtgagacattgtcatttttttgacagacgaggaccttcgcggtgtgacataaaaaaaaaataacggaagaaaggcaaacaggtgatccggcaaaactcaactgccaccttcgccaactctgacaggcgacggtcgtttttccagtatcctatcaatcagtccaaacttgagagcctcctcggcatccataaagtggtccctttccaccgctctctctagaagcacaacgtgggagaaactgagtttctgattgaccgatttccaaacaccatcgacttggacctcatcttacctatggcttccagatctttgacgttgcagtgcttctgatagatcctgttaagtctctcgcgcaccctcagaatctctcttgcgtgaattgcaatatcactggcttgtccgctggctccgccgctgggttggtgcatcataatgctagcatttggcaacgcatatctctttccgggttcgccagcagccagtagcaatgatcccatagagcaagcttgtccattgcaaagagtcgacaccggcgatcgaatatactgtcatcgccatgcgtgggtgatggggaaaacatggagcagtggccctgtcagcgtgctgcattgcctgtcatacaaacaccctgttgacggacgcccaattttctaagttacctgcatctaaaatgtcagatagattagctttcgatgctatacctgtgacactcttgcttcctcattttcttttctcccttacagtgtcatatatggccattccagcagtaacgcttcctccagggctgttaatgtagagactgataggcttttccgggttttctgcttccaggaacagcaattgagcaactataagtgacgcagagtggtcatgcacctatttccacacgcagaaagatacaatcaatcaatggtgcagtatcagctcgcgctacaaaaccgcgcaaacgcagtttaccaacagtcgcgcgagcgtacgtacaggtccgttgagacatatgatgcgttccttgagcaggcgcgagaaaatatcgtacgaccgttcaccccttgcctatcagttgaacggagcgaaccctcgttaggcaaacggcatagcgtatacgtccacaaacagcttccacatcaattccctctacacatcgtcactactcacagactgttccacaacaaaaggcaccaacgtctgcgcggttggttcttgggaccaacccgaagcgatgttgaggtttgagcgaccgtggtactcttgaaggtggctacgacatccctgaaaggcatgcattcgtagggccgatagcgagagctggcgaacatgctttggcgctgccgcctttacgcgagcgaatgcgctgatgacagagtgtgacattttgtgaaggaagatgggctggtccgagaagcatgtaaagtccacggaacctaagccgcaaagtgcggcttagtcacttcacaccgcaagaaaaaaactttgcctgatcaacatcgcttcttttttttcaccacaactttacattccttcataataaagcaccgatgccgtctgctccatcgctaaagcccgacacggtatgcaggcaaattcactcgtgttgcagctgccgcttcctatagtatgatactcatcctttctctgtgcgggcgggttcaattttcataggttggctcacttatcttctgcccagaatgcggcaacttgcttgatattcctggagaggacgacttaattgtctgtaatctttgcagttacactcaccagagtgttggtatgtgctgagcatcgttgagcgatgccattatcatttaaaaaagtcagctcttttgcgttcttgcaggctgatgctttagtacgctgataccttgccttgatccatcaaactagacttcgaaaattttgaggtagtcacaacgagcaaaccaggagcattcccttcggcattgaggaataggcgtgacgatgttcagagcgaaatcaaggacgctagtgcagcattggtacggatatcacactagaggaagccgggacattccatgcaactcgagacagcctgatttaatgcctttgtcgctccttcgttgttattctgctcgattaggtcaaagaaccttgtccaaagtgtggcaacccggagatggagtaccatactatgcagctgcgttctgcggatgaagggcagactgtgttctacacctgtccaaaatgcgcgtaagtattgacaatacttggtacgctttattattgtcaagagttttcactgatcagtcataaccttcttgatttatattcttctagatacaaaacaaagctcaatagttaatattccgtggataatgaagagtaccagcatgagactatcccttaatctgtcaatgaaactgaactaaattatgcagcagtaccggatcagataacagccttgtaaacccgaggcgccttggaagagaaaagatcaaaatgaaggataagtccatgtcaaaaagcagcggctcgaaagtaaaccatagcgcgcggatgtcttaccaaatgcaagcgaaaaataagcagctagcaaaggcgtcgtgaggggtaggagggtgggagaaaaacttgacactcgacctcccttgaccaaaacggcaagaaactgcacatatagtgcctcgttgctatctgtgcaggttgtgacgatggtgtgatctgatccactcacgtcgagacttctaatctgagcggaccgaagtttaggccgcatatctagctcgaacgagagaggtaaggagattgatttgtaaattagagcatgagaatggacaaactttgaagtgaagactggtaacgcggtagtaatcgaggcacttacgtcagagtgagtgtgcggaagtggtgttcctgaggcccaaatcccaatgcgactccattagacgatatttttatgggttcctcgctgacactttctactggcaccaatctcattcacaccacatcgcagcaagcactctcgagtgtggccacagtgagcctcctgtaatctaagagcactttcggcctcgcccaactttcatgacatgattgtccatcttgatccacaactccctgttcctcctcgcgcttgcgcttccggggttcctgttcctggggtcgctgagcacgcatcagcagctggacgttcaaaagaaatactgcgggaatagggggggaggggggaggttgctgttcacagcaatatccttatgattatcctctgacacaatgtcttctggctctggatcaggggtgtgtctggcctcggcaatttcgaagacagcataagtgcttgcaaaggccacctcaagagatcagcgcagacacagatggggaccagatatccttgcacgttcacactaactgtataggccgacacaagccttactcttgcctaggacccagtaccgagtccactctgaagaataaagcatatatcgactgcgactcggtagtaccatattagctagcggacttcatgtccagaagtctgatgcatttgtggcgctggcacgtcgacgaaagaggttgatgagtgcaagagcatgtgcgagagaaacgactctgggggcactcaaagcttttgtatgtttgagatgagaacttggatgcccgatgacgccgttaaggagacagtagcttcactcgtgcgcgtcgtctcttgcccgtgtcgaatacaggtgcgtgagctgctgcctagcagagggcagggccaatcggattttatcgaagggccgacgcgcaaacaagtttgatgagcatgctgcgggctgcggctgttatgcgcacaccaccaccaccctgcccgtgaactgcccatgcagccacgtaccgccgtgtcgcttctccaggctcagagaagtcttcttggcatggcctcgtaacttgagaggctgagaggtgaaacagaatgggactaacaacgcgatcagtggaatatattcttctctctgttttctctgtcctctgcgtctctcgtctctatcttctacttctcgtctctgtcatctgtatctgtcttctgcgtctcttgtctctatcttctacgtccctcttctctatcttctctcgctctttgcatcttccacttctactgtctcactctttggcttcttctctctctctctttgtctctgtccctctctcttccaccgctctttagtctctcttcgcttaaaccctcttctaagttgcttccaccccccaccaccacaccatgggtatcccgggcctttggccatttattcatcacaaagggtacgaagcggacagcttcaaaaccgttgctgctgctgcaagtgacctccaggcgacacaccctcggttccttgttgatgtccaagcgactttctacgcgaccattcgctatgcatatacccataaggacatcgcgatagcccatgccaccttgcagcatgccatagaaaagactggcctcaccacgtctgcagttctctatctcgacggcggccacccccaagaaaaacagcggacgcatgaagacagagccacgaaatgtagggacgcgctcaagcgtgcagaggacgcactgacaactcttcgggatcgagttcgcactggcaaaagggtccacaggcaccattttggcaatgttatccagaatgccaaggacggtttccgttggtcgaacgaagagcgagagtcattcgctacgtggatgcgacaagcaagctggaccgtcgtcgagtctccgtttgaggctgatgttgctattgccagcgactgcaccccgagcgatgttgtggtatccatcgatagcgactactttgcctaccgctcagtcaacatcattctccggccatatcgcggtggatttcgcaagtacgacatcaatcaagtaacagcacatctgggactctcgcgcgaccaactgacggccctctgcgtcgtgagtaaaaacgactatacgtcaaacatcaccatgctcggacctgagacaaatctcaagttgattagcaaagctccgcgtcgatggttcgtgtcctgctatatccactgcatttttatcatatcaccaatccaggtcaacttacaagcatcttggtctatttatcaacgccgtctagatgccagcgcaattgtcgaggaatacctcagagacaaatgtgtaagacgaaagaacacatccaacgagtcgtttgcggcctctttgcgggtctttgtccaactacagcagagcgctgtttccggtgtggcatatcaggataaccagcaaccgtttagggaccttttgcgacagcttgaggcggtgaagcaagagtacaacgccaggaagtagctgggtctctccagagatggtaatgccccgcgcaagttgtcatccgataaaggccttcgaacatcttttacaccgtggacaagcagcacgaaaggcgacccaagcctcatccatcgggcaggccataccagtaccgcaaacgatactcgcacaagctcaggaccccgaaagtccagcatgcgccgccagacacaatgaaaatgcacaagtggaaaaggccgaaggaggagatcaatcaggagactgagtgcagcagccacaccaacaagagctgcagtagcaagaggagaaagacgtccaagtatgagaagaaggacccggagaccatggacaagggccttgtgtacaccatgcaagttgagcacccctcggtcacgctaattgtgggcaccctcaagtgcaacctggagaaggcgctggctaggtccgccaatgacactcaggtcaaggaagcatatgactcgctcgtttcgtccaggaccgataccacgccgacattgaacgacctggccccaaggatcaaaaaatgtctcaaggatgtggtgcggctggcctcggagacaaagcgcatctgtcaacgagctgtggccgtctacatcgatcgattgtccaaaaacggcgtgtcagaccaagacagaagagtgctcgacaagatttgtggtcgggcctccgcggacaagcaggatgacgacgacgacgataacgatgagaacggggacacggacgacgacatcaacaagaagcccgaagtcgccttcaagtttggtcccttgaattgcatctacaaccgcagactgccctacaagtccaaatcgtccgccgaaatcgagcatttcatcaatcaagtcaaggacgtgctgcctaccatgaacgaccctaaagccatcaacgagcggatgccgtatcctgcaaatactgttctgaggtccaccgcaaccacgcttgcaacgtcgatgaagcagcactttggtcgtggggcaaagacactcgccgaaaaggtatgtgtcgctttaagtagactgagcatgtgatttcctctataggcgatgcagtatacccatgcttactacgtctatatctataggctaaaaatctccaaaagaagggtcttcttggcgccgatgtgtgttgcaacatcaatgcaggaacttcggccatcgagaactttcagcgcctgaacaagctcactggcaaccgctacaaagtagccccgatgtcctcaatagaggatggcttcatcactctctcggagctggaccttatccatattttctgcaaagatcaggatctcaagtttttgcttcagcaactagcagccccagaatttacaagcacgccgaacccttcagagggtgacctggtggcctggatctccgacaaggagccagggtttctgatcaccaaactgctcacggacgttggcacatatcacgatcatgaggtcaagaaacaacacggctaccgacggaatccgacgacattctcgccgagctcgatgcgggaccatctgagtgcgatacgacagaaggatttctctccgggcgactacaaggaaaaccgctatgttttgcgcggatcgatcaggaccgatggattccagctgcagctgctagcattcaagacgaaggtgcttcattcagtgaagtaccgcagactcgatgaaagccggttgccaccaaggatcagcactaccgtcggagggaccgactattatatgacggagattaggaacgtcatacaaagtgcggaggacgtgacgcgtctctggaactgcaagcctgaggaggtgaaagttcttgggattgacctcggcaaggcgtttgtagtaggagcatgtgctctcgtaccgacaaaggatggggacgaggacgaggtgaggaccttgaatcttgccgtcaatcagcgtgcggtctaccggccagtattcaaacatcgtcgttgggccgagtacaagaaatcccagactgccagcggcggtgtcagcatcaaggagatcgaaggcgaccttccgccgctgagaggaagcgatgccgatgtggagggctatgtgacgaaggtcaaggacgtggagccggcacttgtgaagttttacagcgacgacgatcgcgaaagctggaaacgacacaagtttgacctcaagaaagcgttcgacgaggagttccgggtggtggccgacagcctcttgagaatggtgggtgggacctgctcggctccgaggcacgaggacaacaaggtgctcatagctatcggcctgggggatttcgggtcgaacggcaaactgtcgtcgctgcattctagtttctgcagatactttgtcgagctggtaagatgcagacacggcaaggaattgtgctgcaccactttcgatatttgtattaaccaaaccattttgcattttaggcgcgatctttgggatatattgtttgtggaatcaatgaattctacacattcaaaagatgccctcgctgcgagaacttcgttggacaagtaactattcgtcggctctattgtccctcccccacctgccaatcctatgtccaccgggacgtcttgggcggacacaacatcgccaacattggcaagtaccgcctcacacatggagagaggcctctttatttgcagcccatcgactcgcaaggccgccatctttggacaaacagcggagaagcctcgacgtcaactggaggagagccagcaactggcagcaagaggagctgccctgagtagttggctcaaaggtggtttttttcagtatgtgtgttagccaacacacgaacacgttggaatatggggggcgctatattctgagtgtgcaagtatccgattgccacctcaaggtcagaactgctcgtccttttgcttctgtagctgctgatgcagctgtcgatcggaggcgctggcaggtttctgacccagtacaacgtggtagttgatgtatgccttcttctccacagcctcgttgaatatgctcctagtcaaatctctatactcctgcgaatcaccatgtccttggcgcacgtagattggctccaactcattcacaaattgtttttgatttgccagcattgcctgaccgataacgccaccccagccaagtgggatggaccacactttcacggagacgttgacaaacccggcattttcgagcaaatgctccatctcgtggatcacgttcggattgcgacccatggcctcaaaaatcccgacgcagtactctcccgcaagctgacagagttcaccgccgcccctcaggaacaagtctggctcaaggatctcgacccatcctcctcgcttcaaaacacgaaagagctccaaaatggtccgctgccattcagtcgacatgagcacaacagactgccgtctttgatagacaaagtcgaacagctcgttctggaagggaagcctgttgaggggtacgtcgggttggaaaacgcaattccgaggacggatgttgggtcgaatagacgaacctgatagagtggacgcggtcgttgatgtggcccctgaagctaatgcagcaggaacggagttcggggacgggcttgtcgttgggctagaaccttgctgagattggtctgctcctaaaagtccacgcggacggatgataggcttgcttttttctgcgttcgatgtggtgaacgtgatctggggacatccgacaaagtccgtctcaggcatttcgctcgccatatcctatgcattcgcattcgtcaatggcacatacagaagttaggcgttaggatcgcgtgctgtacacaagtgcctgtttaagtaaacagggctgaaaaaaagctgtaagatgcgcgacaggcagatcaaaaagtgaaccattgatgcacgccaagcaaaggcgcggcgactccccaacacaaaaggtaaacgtgcatgcataatcaacaaatatcccttgacctaatcttcaaacggaagtgatcgcctcagctcgttttcgggtcctgttgttccatgtgttgcatggttgtacgactatcccatttcttcttttccatcaccccataaatgaaagtacaataaggttagccccccccctctctctgcagtccaaaagaatgcaggttacacatcaaaactgctcttttttttttctctttgttgaccagcagggtcgggaaagtctgtttttttcgtctcttgacaccactagtagctccgaccaactgcgccctcccagttggcgtcgatccatcatacagcgtgcggtagtgatagtggacccagcgatcaattgaggatggagagggaggagtaaagagaaaaagagaagccgacagaaaagggagaggtacaagggaagagcgaaaggcgggaggatggggagaacgagattgaggaagcggcggccgactatagacaaataaaaaatacttacaagggtccagtctcctgcgccgcatccgttttcaagtacacgcttgaaagccagatcgattggggcatgatagttgccagccataacatccttgtaaagataatgctgttccgtaattctgcgtggccatgtattgatcaaacatatcaagtaccgccacaggtagcatggatgggagttgaaaaaggacattgagacacgcttaggtacaattatacaatacaattttgataataagcaggcttacataaggacgaaagggagcctctggtcaaacgcctcgtacataccgatcaacatatcccttggcggcttcaatttccatttcgttgaggagcagatcctgatgataagcccatgaatcatcgttcaaggtctcttcgtccaagtctgacgctgctggcggcagtcgtttctctaaccacgcgaagccagccttgccacgaataaaactaagtttggatggtcgacccaatgacgctgccgaggactgcttggagctgggcgttatgggcgagaagctgttcgatggacaatgctttgcaaagggtgactggtcatccatgagcgattcttgaggaccacggaacgtggaaagcgatggcgaaagtcccgtatgatcgcgctcgttcttgagaagtacggcgccattggattcccgcgctggctgcatctcgagagctgtcggttggtggggtatggagttcacaaaggccgagacgacattggagccactttttgcactgtgtgtggtggtgctctgctgtgagccttgtaatgacgaagctgttgtcgtagcgtggaatgagggggaggacggcgcactccatgtggatgcaatggctagagggtaaggcagcggaggagacgtttgtgcctgctgctgatttgcctgctcttgtcgtctggcctttgcctgctttttctgcttcatactgttaatctttttctgctgtttctgctcccaaagatcgctcaatcgacgatcgctatcgtttttgtcgcccatgtcctcgacctcctgcgcatcattgttgtccttgttcttgttcaaaattgagtttagaaaagacgaaaggttgctcttggagctgacagcagactccgtttttactcccggaatcgattccccagtgagctgcgagttatcttgatccgtaaaagctccggagctatggtccgccgaatacgtgcgtgggccatgtccaggtcttgcaggggaagtgagtgaaaggtcaacaaaccccctttgaagaccactggcgccaggctttttttccttgtatgaggatgcagtgctgtccgtggtggacgtccgcgagagggctttgttcagctttgacgactgagcccccatatcgtcctcaacgatggtgcgctcgatagcaaggctgcccttacagcggcggtatgtctttgacgaatggaattgaggatatctgggactcggttgctggcggtgacgggtacagaaaggagtgcgttggtatgggggaggtggtgaaggtgtcaagagagggaagaagagcagcaaattttttcgtgctctttcttttttttttttttttttttgtccgtcctgcaacgctgctgccacgtttttctttcgaggtgcgatggtcccacagcatatccacgctgtccaggcgactggtaccatcgacaccccttggctactgatgcacgataggcaacatgcagtctaatacttcgcaggccctgcgacagcgcatagggagcaggttccttgtgcgacccaaaaatagtccgcgggactgcgatcggagtgggggtccgcaaggggagtgcctgtcttggcaactttcgcatggcttcgacccgtcgactgtctggattccattcggtgcgcctttttgttcctcgtccgagcacattctgctccttgcctccccaacttcccgtcctccaactccccaacttcccaactccaataccgtttccctgcatcctcgccgtccctgcctcccctctgccattccccccccccgctgctcagccgcattcctcagtaaccgcgccatggaaaacgaatccttgatcgcacagatggaggactttgaggtaagtcttggcaaacagtctacgctcatagcgtgtgtggaggacaacgtgtctgcaccagcagagactcttggcccctttggtgaaggaccgcttaccattagctgcagccactgatagtgtattcgttcgatatcgacttcgcccatgctctactagttagagcactctgacgcggctctcaagccaaagttgctttttacgcgctccaaggtcttcgtcaaggccacagcagacaacaaggatggcatgcctgggttcctttctgtgattgagacggtatgttattgcatgaccagaaaatgccaagaagctgcagacggccgaaaacaggagttggtgaaatcttggcatctttctcaattgtttttcttacgtctggtgttcctccattattagacaaactatgagcacatcctttcctggactccagaggcttccatacccagcctcgacaatgacgcatacgtcgacatatccagccaaggagaccacgatggtaatataccttgcggcggttcgtgggatgtcaaaaagagcttcgctaatatcgccttcttcttttcagtcacgacgttcgttgcgcctccaagatctccagagccacatcgccgctcgttccatccatccgattatgctgtctcagtgactttgcagagtatctactcgcttcttacatatcctcctcgcatcaaggatcgccatgggtccgtcgttgtcaatcttatcggcggcgagtctttgccagcattttactttcacgacgatggtttggcatccaagggcaaggctgctgccagtggacctccctcttggggtggacaagaaatgctgcaatgtctggagcatctggtggacgttgtcggtagtgcaatcgaaccaggtgttttcctcatcaatgcgtctcgcgacgacaaggtcaatcatggcgcagcgtcgcctgaaatgcgacctcgggtgatcgagcatcctttgcaggaggagctgccaagggagacattgggtgatgaaaggctctatcccgctttgaatgaatctaccctttccccgcagtctgttgacccactctcatcaggctcatcgggttcaagattgtatgatgctgcaacaacggcaggggttgggcctatcactgtcgaaggcatgcgacggaggcgctctcccagtaacaataggagcagaagcagaagcagaagcagaagtgttggcggaccgagacctgaatcaactggcggattgtcagtggatgctactgcaaattctactgctcgtgaaggagactcgcattctgcacgtgcaaggacgccgttgccttttgacggtagcatagacccgcttgtaaacgtaagggcctgcaggctgcattcgcctgcattgaggattattatggtcctagatatgttgctcggtgatctccaactgatgaatctcgacttatttacgccactgtttagaccgtcaaagagctccgttggaatattttggagagattctcgcaggtagctaggttatctcgagacgcagcgacgaatatcctcgaccatccgattaccaagcaaattcttcctccacatgtgcagcaacgcattcaggactctgaggctgcacggagggttatggatgattatgactctgctcgtgtttatctagcaaagtgggctgctaccgttgctgaccaaggcgaccgggagcgtcgagagacgcgtgagttggaaaaactccatttgggttctactcttggaacacacaaggcccatggacacaatggtcgtcgaatcaacgaccatgaagacgaggagggaccgctgggcgccttcaatgtactcgacgtaagtcatacatacatttttaattcaatgtggcagttttgtggcatactcatcgcattctttgtctcacatcctcttttgaaacagctggagacagagtgctctttgatccatcacactaggactgcacctctctcacccatggaatggtttgccttctttgatgatgcaggtcgtttaaaagtcagcgaggctaaagtgcgggagactgtctttcgcggcgggatcgaccacgatattcgaattgaggtttggaaatttttcttgggcatttacccttgggactccaccgaggcagaacgcatagtcattcgtgccgccaaagcgtaagtagctgatatttcgttcaaaactgtccatgcgcgcgtggaagcgcgccatcacggaaaaaaggcttactggccggctcctcctcttaatccatttagcgatgaatactatgccttgaagcgtcagtggtttgacgatccaactatccaggactcagaggcgttccaggagcagaagctcagaattgagaaggacgtccacaggacggacaggaccatatccttcttcgcgtcagaaacattgcccaatccctcaggagactttaccggcgtcggatcgaacgagaatttggagctcctcaaggacatcctgctgacgtataacgtatgggccgcagcaccatcctcagctttagctggctctacgaagcctgttatgacaaaaactatggcctctgcatcatctttcgctacagaggatttaggcgaatcatctccaccagcagagtccaacttgctggaaggttatgtccaggggatgtcagatctgctggcgccggtttttgctgtcatgggcgatgaggtgatgggcttctgggcatttgtcgggctgatggagcggaccaaaaagaacttttaccgggaccaagtcggcatgcaaagtcagctggagacgatgagccagcttattcaagtgttggatccaaaactttacaaacatctcggtactgttccttgtttaatcgccgctgcatcctgttatctctcaatgcagttgttcgctgtggagctcctcatgtgattattgctaacatggcccacacttgccacaccttttagagaaatgcgaagcgctgaatttgttcttctgctttcgttggcttctcatctggttcaagcgggagttcgaatgggtggatattatgagactgtgggaggtgttgttctctgatttcttgtccagccaattccagctctttgtcgcgatgtctatccttgataaacatagagacgtcatgatggaccacttgcaaggattcgatgaaatcttgaaggtaattgacggaacatttgcctcttcgtcgttttgtctctgttcgctttacgcttaccacttaccacttacacggaccctattcgcctgtgtagtatgtcaatgatttgagtatgacgatagatcttgaggagacgctgcaagatgccgaagttctctaccgtcgattggaaagcgtagccgaaaagatcgataccaagagaagggaatcgtcgtccgaatcgtctgcactcgaatttcctgctggacttcggagcctgctcagtgcgaggacaacgcagtgaaataaatcgggttattttttttattgctacatgcatgtttataaatacagaaaatcaatgcgagaaaaatgatacaatggagggagtggcgcactgttatgaactagcgctaggctagggtcgtggggtaaaacatgtgcaatccgttagcagacgccgacagagctttgccttgagctacgacccgtttggctgcctgcgttgtgatcgcgtaaagtgaaagactgtcgagcggaccccagagacgaggatccatctcaaaagtcgcacaggggctggaactggtcctgcacccaattgcgtggcaaggcgacatgtttttatcaatcggataccgaggagcgcttgagtgcgtgtcgaggggatggactgttcgttgcatggactgtgaggtagtgaaggcgggatgcgactctggatgacagcattgtccgtgcttgtcctcgagcggatgaaccgcacctgaatgcttgaaagagttgggcgctgacatggcaactgggtagcgatccctgcaggaagatggcgccgctcctgagccgttcacgaagtagttaccagatgcgctacgctgatgctgagccctgaaagaggtcgacagcgcaccactgctggcacgttgggacagctccatagaacgttggtgccgatggtggcttcgctgatggggctggagcattggcgactggtcgtcaaacatgtcctgcgcagagttcagccccattaaagtcgacatggacgatgatgaagagtatcgcttgtgggtcggaatagctacaggggtcttcgcagcatgactagaaagtacagactccaggtgaggggaatgatccagcatatcgtcaaaggcgatgttggcggagcgtttgcgttgagctggctcaggaaatcgctgatggtgaccataggtcagcgtcgaaggcgaggatgagaacgacgtcgattgtttgtgatatgatgctcctccgatgggctgctgctgtacggccatgtactgctgctggggcgggttacagatggaactgaggggtggctgggtggggtagtgatgcgacgaggctgggttccgttgatatcgtcctccagaaaatggcttctgctgaagctgctttacagagtcaatgtagttggagatggacgccatggacagcgccgtggatgcagacgtttggctactgtacattcccgctccggacggcgccggctgccgcgtcgtcagtgaaggcatgccgacagtcaagcctgtgtcctccatcggagagataggagactgagctgctgaggtctgctgttgacaagcaaccagatgctgcgatggcatgtatgctcctgtgaactgggtcaaattggcgagccattccgagtagtgagctgggctggtgaagagtctaaagtcgatcccgttcaagaactgcatctcgaggtggttcacatccttgatcttcatgcccgtgatatcagcccatgtcttattggtaaaggtgttgtcgtccaaaaacttgttggcgagaattaaagctccagtaaagaaacgatattcggctccatcgcccgtgttgacaatcttgttggatcccttcaagttgatcatcagctgttggatatacttgagcgatagaagaatgacactaggtgagagaagggtcgcactgagcacatccaggcagaacttgcggaacatcggctttggctgcacaatatccgactcggaggtaaccctgcggtgtgttggtcgggtcaaggagggctgctgctgccaacttgggaaggcggacgaggttgttgaccgaggttctgggtagatttccatctggctgcaagccccgcaggggcaggctggcgctttttgaacgccttggctggccaaaggcgacgaagggatggaggatggtggagtgcctacgccaggattgaggctgcgtccctgagctctgctagcaagttgaccgtaaagtaggtagcagaccatatgagcagcaaagtcggcgagttgcgatatcgtctgctgctgctgctttcgactggacaacggcgaaggctgcattgagaaggagtttggagcatgggcgctcgaggcagcaggcggtgccaatatctttgtgtcgatcaccaacggccttggcgactgctgttgtgaatggtgccctaggtcataataatgctgctgctgctgtggttgttgttgcggtggcaggtgaacagattcggagatggcactctggttgtagcgcggagccgagttggaaggggtggcgagatatttggactgctggtgctgctgctgtgaagtggtgccctttgcgcactctcgagagatctcgctgttgtcgtagtatggcggtgttggatggtacgggtacgacgggtggtgctgggacgagtactgcagctcctgctgcgagtgcgctaatgtcgggaacatgctggctcagacagggcagacagggcagacagggcagacagggcagacagggcagacaggacacacaggacacacaggacacacagacaagacgggagagtgagagcgaggccgagtgaccgactgatagtgagagagagagagagagagagagagagagagagagagagagagagagagagagagagagagagagagagagagagagagagagagagagagctctctctctctctctctctctctctctctctctctctctctctctctctctctctctctctctctctctctctctctctctctctctctctctctctctctctctctctctctctctctctctctctctctctctctctatctccctctcgctcgctcgcttgttagctccacttttatacaccgtccaccttgctcacacagccaatacccatgacattccacgaagagcacccccacctctccgtcatcggagactttgtctcgagcatcggtgacaagatcagcaaaagccttttcaaaaaagaagaggccgaagccgaggaggtcgtcgcgatccatgacagagaagagcttgtcaccgaccccctgttggacgaccaggaagaatgcgacgatcgcgccatcgaagcagctcgtcaggagtatgaacatatccgcccagccgaccagttcaagtgcggacccgttctccgttaccaagatatccaggtcgaccgccggcgctggatcggctctgtgctgatcgtcaccgagaatgagggcctgcctcctcgtcttgttgtgcgtgaccccacaaagcctcgcgtcggatactcgcacccccgacgtctagagagctgggagggaaaccacttttaccggtacgagatccagctcacgttgctgacccaccgcgagaagcgtatccagtactggtttgagaccgagaacggtgagcgcgtggccacaccccagacatggaactttcatgcgcccgcgctggatgaggctcataactgggcgttttattcttgcaacggattcacgtcggatgtcgaggacccagagacgaactttcatggggcgaatccgctgtgggacgatctgttggcggcccatgataaaaagcccttccacaccatggtcggaggcggagatcagatctacaacgacgatgtcctggccacgcctgagcttgcagagtggctcaagttggagagtgacgagcggatcgctaccgtgttcaacaatgagaagaagtatgcgaccgagaagtactactttgagcattacatcgagcactttacaacgggcacctactccaaggcgctgtcgctgattccttcagtcaacacatgggacgaccacgacatcattgacgggtatggatcgtatccaccaagctaccagctctgcgaggtgatgcaaggtatgtgatagtccattggactcacctttcgtatatacaagtctcgacttggtgacacttcggtccgcgccacgcccatatccccgtcgcgcactgctattttttttttggctcttgtctcacgatatgccctgccctatattgtctttttttcaacgtgatggcgtatgtgtgactaggtatcggagcggcagcatcgcgcttctaccttctcttccagcagcatgccaacgcccacacgacggaacaggccggtcttcagacgtcaaagtccgggaagggatggaactgcatcacgcatttcggcaagcgcaccatggtggtcctacccgacacacgatctgagcgatccaaggagacgattctctcgaacgaaacgtttgatctgttggagagagagatccaggccaggcttctgccaacgactagacatctggtcgtagttctggggacgccattggtctacccggccctaacatttgtcgaggacgcgctggaaaagatgggcgacaagttatcgagaggcagcgtcattggaaagatctttggcaaatgcaaggcctttgagaatgtccttggtcagtttggacctgaactcctggatgatctggtaaagtccatcgcttccgccaaaaaaaaaaaaaaaaaaaaaaaaatgcacctgtatccatgctccttactctcctggccaactcattgacgccttttactcgtcacaacttcattaggtggattcgtgggcgtgcactgttcatacagaggaaaagagacgccttgttgagatgctgcaggccattgctgttcaacgcgaagttcgtgtcacctttgtgggaggcgatgtaaggggccatttttttttagtttttgtttcttgccacgcgagctggtcattgtgcgttttttctcaagcttagcccaattttgttcttgctatggttgcatgttttaggttcatgtcggtggagcaggacgcctgtttggtacaaagagcactgagcgattgaacgatccctacgatatggttcagatcgtctcctctgctattgtcaagtaagtcgtcatgtattgcagctatttttttttgttcgacttggctcgctctttgcacctttaacgttatccaactacctcccacacctatgctcacacctgcgctttcttgtatttagtggtcctccacctggcatggtgatctcaacactgcacggctgctcaaagacctatgaactgaacgagtacacgtctgaggaaatgtccgagatcttccatgaggatgtggatggcgcagcgcttgagaacaaaaaattgttgaaccgtcgcaattggtgcgaggtgcgcgagaccttggaggctgaacagctgaaatttacgatccgggtcgaaaacctggatcatgtcgggactaaaaagtacccgatcgtcgtcgaccggttctttgctgctgctgctgctcctcgcgaagagtagaagaacaggaaatggatatttttaaagaaataaaaggaagaaccacacatgaatatcaatggagtgtgtttgcatgtacaggtttttttttattttatcttcgttcttggacggtcgggcgagttggataccccctcttcattattacgcgctctaaaatagctatcgtttcaatcgttcaatgggggtcccccgataaaaaaaaaaagagatcgaaaactttttctattatactctttagagagcaagggctccaaagaagccagcgacaccgaggtagacggccttctcgggggtcaagaaaccagcgccgttggtggctgtgctgatgggcgcggcagtcctggtgccggaggggcccatcgttggtgggggggcaccggccttgacaaagacggttcctgtggcaccgttgagacagttgcggccgagaccctccttgtagtagacggtggtgggggtcaagaaggtgcgctcgtaaaagttacccttcttcttggtgcccgagttgaaacctccagcggtggcattgcaggagccggcaccgatggtctggacgatggcgtggtcaccgtcggcgttggtccaacgaatggtgttgccgggggcaatggtgatctctttggggacgaaggagccgttgttgtagccgatctcgtaggtgacggcaaagactggggccatgatggcagcagcgagagagagggcagaaaacttcatggtgttgtgtattttgatttggttttcgaaggatagagagttggggtgaaggtgataaaagtggccaaagtgtggaccccaggcagcttttatatcagaatgagacgggaggccaggttaccgcgtgctggtgccagtggaacacactgagagatggacgataccaatcgaattcgtgcagtgggggaaaaaaaatataggtctttgtttctttcgcgtttgtcttaatcgccgcccactctccattcgggtgtcccggagcaaagtaacagcaccatgaaaacaaaaaaatgtcttcacgatctattttctcattctttgaaagtcgcgaaagacagcgaccctatctctacactgcatgatggaactacatctctttttttttcaaatgtttctacgacagtgaacaggcggaggcggttccaaacggaaccaataagctgagcgcacggacccgtcaggcgcgtcttttttttgagtgcatcttgtcctcgtgcaagtagggctagcaagatcgtcattccagcagatgtcatcttgaggcagcttttaggttttttgtcattcttgtcgtctcggtggtttctctttttttttttttttttcgcctgggaaaaacgcgcgtctgggtccgagtgcttcgcccaagtgttaaaacaaaattacgtctctgaaacatgcaccttgaccgcgagggtctctcttcgttttgccattgccattgcattctcgttcacgagagacacgcatgcgcttggaatgaaagtgcttgtttttttcacttgatcgcctctcattgagaaggagtggcatgtcgcaacttacatctcaagttcgcaatctatgaggacgggagcgaagggaaacactcgcgtcttttcatgccatgaacggctcgacttttgagtgatccttctcagtcttactgcaacaacacttcacataaaaaaaaactttttcttgcgttagaagacgccccactggcgccgcttgacactgatgcaacactgtcgatcgtatcaatgcacggttctttctgatcaccggtatcatacccccggctctcactacctgacaactttgctcactctctcgttctcttctctctggctgtttcactcaaaggccgacgactatgcacgctcaccacccagctggaaatcgcaaaatcagctcattctggcgtcatctcaccccagctgtacccgcctacttgatcaaataactagagatcatgctaataggtctgttgggcgcttggacaggagcctggggcccctttaagccctaaagaggcggttttgaatgatttcgccattggaggatgttcacaaattcaagtagttcccgggtgattccggaatcactggaatatttattccgaaggcttccgtggcgcaattggttagcgcgtctgactgttaatcaggaggttggtggttcaagcccacccgggagcgtatctttttggattttctttcatagatctgtcgtttttttgctgcccgctcacacgcgagaacgcctttctgcttttttcgatacttttgcaagagaacgcggtttttttgcagttggggagtgcacttcaaccggcattgaagccagatcaatttttttttccgggatgatagacagcaaatggcatcaagcgtcgctcggtatgcaggaaaaaattgttctgatggatacattgggtctgttactctgccgccctgcccttagtctctatgggcaagaagcacatacaaatcgccgagatgagaaaggttgcgaaagacgcccacagcgggaaataggtgctgaccgtcagcatagcgcccacaataagaggtgagacgatcccagcactatcaaaaaataattttttgttttgatcaataggcgtgcacaaaggactttcaaggtccaaaaaaaaaaaaaaaaaaaaaaaaaatgcgtggcgtggtggatttgccatgaagacgacaacaaaacaaaagtgggtaggtcgagacttacaatctagacatggccgcggccacgccacacgcagtgcctcggatatccgacggaaagacctcgggtgtataagaatacaacactgcatagttcagggtcgacagcagactgaggagcgccgaaaacgtcgtcatggcggcatggctcttcagaactgtaaagagcgcagctgcgagggacgctccaaacgttgaaacggccatggtataccgtctacccagtctgccttctactaggaaagtggccagctacataaaaattaaaaaataaaaatcagaaaggcgttagaaacaacatgacgggcatggatgagatgatgcgcgcgtgtgtacgtgtgtgggttgaaggcggagctagctgagaaagataggggcataccactgagccgggtataccagcaatggcataaacgagcgtgtccatgtaaacctgtttcaaggactgagatccactggcgccatgctcctgtaaaaactttggaaggaacacgttaaaggccgtgtaagcaaacgcgaccaacgcccagatggtccagatcagaatcgagctcagccgaaacctcggtgccaacaatggcttgagtcgatcaaacgctcgccgcagactgtgggaccaccgacggcggtaatgatgaaagaagagcggtgtgtactttgcattatgctgccgttgctgttggtgttgcgggtgatgcgacgacgatgaaccggggcggctgcgaccctcggatgtgggtgtgcttcgcctcaaggctccgagctcgcgtctattatcactcgaatcggaatccgaggacgaggactctcctgaggaggtatccacagcacagacgggtttgttgaatcgcgaagtcagcgtctcaatgttttcctcaaacgcatccgactgaggctcactgtggttgattttgaagatcctgcagaggaccatggctgcttcctggtgtcggttctgattcagcaggtactttggcgactcttctaaccggaacaagatgactcgtccaatcaccataaagagtgtctaacagaaggtcagaaaaagatacaacattttttttttttgtgtttgcggggtgtcaatcgtttgatcgcgttgctgtacaaagcagtactggtacaaagtacacttttcgcagaaaaatactggacagtgtgcttaccactccgccaagtgccaacaacatatagcgccatcccttttcctgacagccgccttcgacttttgtttcgcaactgaaaggtggtagcaggaaatatccaagtagcgaggtcgccgccgcaccgaacgagaagaagatggagaggaaggtcaaaagatgctgatttttcttgggcgtgaactcgagaaacagcgcgcctatatgaaagtgaaggagcgaggctgagtttagtcggtgtccaggtggcgcggcatcatgggagaatgttcacaagtaaagcccacacgttaccatccacctatgagcagtgtcgtttgattaatgatacgagaagagcagatgttgtaggaaggaggtctcagtgaggcgtagcagaatcaaaaaaacacgagcatctgaatctacggtgcgtccatagcactctcatgactggctcttaccggcatgttcccaccaacctaaaagcatgaaaacaaaaaaataggcagacgttagccatcatcgaaaagattgtcccgagctgaccctcttttcaagagggcatcccatctactacatcctcagaaaaaccaagagtgatcgttaccccaaagcctagacacaggatcaacaggcagagaagccagtaagagttggcaaagctggctgcaatgccaaagactgtcgtgacgatcagggtgaagttgaaggcctgcttgcgcccttgagcatccgaaagcatgccccagaacatcgctccaaacatcatccccacaaacatggagctggagagaatgccgatgtaccggtcctcaatctcaaactgtgctatgtgtttgtataaagacaataggatggccatgggctaaatgaggtttcgttgtgtaggactgcaatacgctgtcgatgattctctcacatgtcatgctgtcatgtacagttgctcctcgttaatgattagcgcgatttaccttgtactcgaggtaggatcagagcaatgcactaaaagatagggtgcgcacgaattggttgaaagggccatcagttgaggcgtgcggaaggtaagtaatacatttctacacattttgtgctccagctttaacctgcatacctgtagccacatctatgaaagtaggtacaggcgtcaattcagttggtaatattcattgatagcgcttcttctcacgccttagacgagctcttggagcgcgcgcataggccttacattatcagcgaaccagccgaggccacagagcacctgtcagagaaacaaacagagagaggtgagatgcaaaaaacagcacactccacaggagaatctcacgctgtctgccggggacaatatatggatatatatattttttctttcttcgaggtgctcgtaccaggagttgcttttggaactttcccatgccaatatcatccatgaggtcatctagaaggttcatctgctcgatctgctcctcgggcgagagcgaccgcggaggcggggacgggcattcaattgtgacggaggactgcgcctgtccctgccgggatcggtcgttggatggcccgggcattgtggggcgtcgtcctggatatcgggtctcacgattaatagcaagactgagagagcaaagggtcgagagagggagcgagagggagaaagaaaagagggaacaggcgagaaaagagtggagagtgtaacgaggacgcggatgagaggggatgatgtcggggatgatgtcggggatggagaacggggtggaatgaacaattgcagattgtgtgtgaggggacttgagcgttagtgcgttccttcttgggccagtatttgccgtttggcgcttgggagcgcacgacggtgtgtatcgacataattaacaacagcgcagtgtgggggtcaccacgcagccaacgagcgcgccgcgttgtcgtaatctccagtttagagcagggtacctccatgcgcgtaaaggcagcagcagggttttctctcggccattattacacaacatttcttcactaccagaaaagcagacaatgtggataagcaaaaacggacaagcaagcgtagatccctacgaggcctagagtattatgagataggggctgaatcgagattctacaataattacaggtatgatgagaaagccttcttagggggctgcagcggtgggaaccgcagcaggcacagcatcggcattgttgacagagacggtggagcctgtgtgggctcgctcgagaacaggcgatgccgccgctggcactgcagcaggggcaggtgcagcctcaggatcggggacagccgcagggacaggggcagggacaggggcagctgcagtgactggtgcaatgggttccgcaacgggggcagacgcgacggcgggtgggactgcagcttcaggagcggcagcaatggccactttctggtccaggtgtacttctgcgacatatgggggcgaaggaccctgagtgtggtcagcctgcttgggatgcatgacagaagacgatctcataacggatcctgaacgcgagatcgcggcaaggctgccatcaccgggctgagtgaacgtcgaagactgagcacgcttcgagatctcgctccaccactcgagcatctcctctctcgagtgggcacgaagactagttcaggagggaaaagaacgaaatcaaacagaacgtcagaaagaattcctatcttttggcgcagttacacactaaatcttacacttacgtgaaggtctgagcgtccctatgcaaaaggccacccttgcccttgccgtccaacgaaaagacgtgctgcttttgaccagcctcggtatgtggtccgagggtggacgtgggaatgtaaatggagtggtcgggcacagggtctttctcgaggtctgcagatgcaaagacatgaagccatccagcgagcgtcaagacaaagtatccatccttccagctcttgagaaccgaggattgtctgctgagatgggcagtcttgatgggaaccacataaggactgtccttgcatgggtagtcgagatcgtcggggttggcatcaaccagatccgaggggaagaggcgatgtccatggcgctccaagaagttgccccattcgctgtcctcctgaagaacattcagggcgagctgtgtaggggcccaagattgaatgaaggcattcgtggcattggcagtctggtactctgcaaaggacccaagaatctgcttcacctctttgatgatgtgcgcctcaaacgtcttgacttcgtcctggcactgcttcaaagcgcgagcaaaaaggttctcctcatggacctgtttagccaactggcgtttcagcactgaaatggcagttgtcgcgtcagtgagggaatggagtactacgttggaggtatgtcgcaccacgaactgtgtgtagaaaggcgtacgactagccaagcgcgcttaccgatgttgatgacataaggatccgagttcatcttctccatatcgtgctgatgttgacccgacatttcaaagaggccgatggctttggccaggcttgcgatcttttcctgagtggcctcgcgttccttgaagaccttgttgttgtacaagttggtgtccgccttgagagccttgattctgcccttgatgtcctgcttgagtcttctaaggtttttgacaatcgtctcctccacaaagcgagcagcgttgatatgctgatcgctcctggttttggcagactctttgatgcccgcgcacacgtcctgaagaccgcccttacccaagaactgctggccgtccttaaatggaacgacaatcacgcctgcggccttgttcatcgccttgctcacaccagtctcgacctgggcgacctctgtaaagtactgctgcaagtttttgaccactcctctgaaggccgtcaggcggttcaagagaatatcggccgggttgagaccctcgccgtcctcgcccgaaagaccttggcggctcatggtgctagagttggagagtccagttccgtcgcgcagatgcatcgagttgttctgaggagactttggcgagtcgtcgtggacgggcgaggcaacacgggaaatgtcggtcgagtcagggggcgatacgctggccatgttgggtgtgggaatcgagactggcgagacagcgttggccaaaccacccgcaaccggagcgggggccaaggcgccgttagagggaggggggctgctggcggttttggcgggcgcaggagcagcgacgggcgcgggaggtgcaggtgcaggtgcaggtgcaggtgcaggcgcgggctgggtggacttgcggctgaaggtacgggagaaggccttgcccagagttgatttctttttctcttccatgtcgagatgaagcgggctggtgatgaagggttgatggaggacggagaggaaagagcggaatcgcgaatgagcagcaccgttggaggagcgcgagcgtgctttatagcgccgctggtgtggtgcgagccgcacacccagcgtgcgctgcttagcacatccgctgccagcctgattgcactgtgtttgtgcccccagaggggattggcgcgccaattggagcggacctctggtgtttatcgggacaaaaagaagaaaaaatgcaggagcgcacacacacacggtagattaccacctctgtcactcaactgactgccagcacggcggtccaccggctcttgtcgttcggtccggactcagatccgccaggccgtgctgtcatcctcgcaagcgcacaagagggctgaccgtgacaactagaactggaagtgtgcaggtagccatcactgagcgcccacgagcgcgcttgatggacgagcactctttagcaaccaattggcggaccctgccatgacatctcgagcatgtcagacagcatctattctacatcatcattatcaccgtcgtcgctgtcgtccctaacgtctcttgaccttgccatcttcctctatcgagtatgacacaatacttgactcctccccttgggccccttgggccccttcttcccctcacctttcgccttccccccccttcctttccatctgcttgctgggtccgttgttgtgagtacgagtggagagatggatggcagcagcaacgtgtgtttatgtcaacgtgcgcgtgggcatacggtgagtacaccatattctcctgcgagggctcccattcgcagcgatggcccccaactctttttgaattgagttcaagcggagtgcgtgcgacaggagtcagtgtctctctttcccactatagagtgcattgatgcatctttcggttgtttggagtgagagttggagtacgccttctttcgatacaatagtcttatgcaacgcgcaccgttcatctgggcacgcacagcagttctgacactgcacccacaacctaaaactgagggtcttcgatattgatctacgtgcctggtgcctgtacccaggagtcttgccggcgtcccattcgatagccatctccgggacctcgtcactctccagctctaacggccaataaaaagctagctactggcatcattattcagatacatcgtcatttctttttttttgtaaacccgtcgcttttttgtattattgagttactttttctactctggatgaccaaagtacagcgtcagtagtcctttgtggtcaagtcgtcgttcctggtccatttccagcagctctttgatgacctcgcgtgcagtcaagtcgtcgatctggtcaatcttctgggcgtgttcctccagttgctggcgaatcctttcatgtgcccttgccctgtccaggtcatcgtcgtcgtcatcatcctgactgtcccctgccaaggtcagcttgtcgatggcatccgtggacgaggtaaacatgggctgcttggcgtgcatctcatacacaatctgcccaagcgaccacatgtccataggaatcgcggccatcaacttttcagtctcctgactgctacttgtagtaccctcggacgtagcggtggtcgtcgtcttggtgaccaatgtcccatcatcgttggaattctcgacctcagttgtaacggtactcttggtctcctcatggcgatgatggcgggatgcagcaagaatctcgggcgcggtgtaacgtgtcttcgccatagacaggtctaccgcctcgcctacgaagcgtgcatggctaaagttccagagcttccactgctgcgtcaatttgggggcatcgctgtcggtggctgtggtgtcgccataggacttgccagagtaagtcgagtaggacgagaatcggtacccgccctgaccgtctggctcagagtagtactcttggaggaagatgctggcgggcgagagactcaggtggacaacctgctggtcgtggcaccacttgagcgcggatgcgatgccttcagtaagggacttgatctcgggcgatgtcaaaggaccctgtttcgccaaggactctgccgcaggcgtggagggataatcaagagtacggatgttttctcgctcccgaatgtaagagtcgagcgtgcgtgtgaaaggacccatcacggacacgaatcgatactctgcgaacgcgggcagagtgtagagcttgaagatctcgacaatgtgatccgatttcaggtgctggagcatgcctgcctcgcgtttccactgatccacgttcttcatccaccgcaaggaccgctcgcgtggctcggactcattgttgtcgatcgctccactgggtcctgcgacgataggcgagggcagattctcttcctggctgttcattttcgagacatcgcggacgtgagagaaggcacttcctgaaatcttgacctcaggcgctccactgatcatctccacttgattgaacatgagagtgccaggcgctgcagttggaactgccagggttgcatccgagcgttcgtaacgaacaattttcagcttgagggtgatttgggtcttgttgatcgtcgtttgcgccggttggtgttcgatgataacttgaggattctgggtctgcttggatgatgaggactctgtcatgatcgccgaggcgacgccgccggcagctgccattcctcccacgacgaatatagccttggttggaccgctcggactgatgctcgaggcagagctactggtggtaattctgccagggtaaagcacggaggacgagtcggtcatgcctgagcttgtagaactctcatggctgtggctgtggccgtgcaggtgctcacgctccatatcattgccgtcttcagtggagagtatttcttggggttcaccagggatgacgtctgtatgggtatcagaggtaacggccgttgtggtctttgacgacttggaaacctccatgcgagcgtccttcttcgcgtgctgagcggcagccctcttctttgaggacgactcgtcatcatcgttttgtggcatctcctcctttggccctgtgactgtaatgggtagaggacctgcaggcagtgtaggacttggacgccgcccaggaacctgatattcaccgctgcttccaaagaacttggctccaggtgttcgtttgatctccgtcatggggccgctggtcacactcgtcgaggaactgctgtgggttgtgtgatcatgaccgtagattggattaacgacctttgagaggttgatcgactccttgcgtctatgcttgtttgcaatcggcgcttcaccgtcattagggcctgatggaccgccatgatgatgttgattgtattcaccgcctgcaaagcctgcaagaggaccgcctccaccatcagcaccaccggcgcccgatgctggaagattatggttcgatccagatcctccgaggttgacaataccaactggcgcagggggcaaggcaccaccactcatgggaagatcatcgtccacttctgcggtctcgcccatggaagagtcgtcgccatctctgtcgcggcgacgtcgcttggcgacaatgaacatgagggcgatgagggcaaggaggatgagacagcccacagcgataccggcgatagtgccagggcgcgttttatcatcgccgtcgcttgtttttgagcctccaggagctggcagaacgccgcctactggcacgaccgcactgttgcttgccatggctggggcagtggcagtgggagcgccgatcagaatctcaccggaggcatcaggattcgggttagggaacaaggggacaacaccgccacctggcaattccgaaccggtgccaccgccaataccagcgcctccgccaccggaacttgatccaccagcaccagcaccagcaccagcaccagcaccagagcctccagtgcccgagcctccagagccgccgccagtgcctgatccgccagcaccagtgccagagccgccagatcctgatccgccagcaccagcgccagagccgccagtacccgagcctgatccgccagtacccgagcctgatccgccagcaccggcaccagagccgccagtacccgagcctgatccgccagcaccagcgccagagccgccagagccagatccaccagtaccggcaccgccagatcctgattccaagccagaccctgaaccgccagtgcctcccccaataaggacagaaccagaacctgaaccggagcctgagcctgagcctgagcctgagccagagccagagccgccggaccctgaaccaccaatgccgccgccaatgaagccgacgccagatccaaactcagagtcggagccagagccggagccggagccggagccagagccagaacttgagctgaagccagcaccagagccggattcgccttcacgttcgctgggcttgtagatgatgatgggcgcggagcctccgagttcaccacgttcacccgggcgcaggttggtgctgcagtcttcagctcgatcacatccaccatagacgataatgccgttgccgcagcttgcgcatgtgaggccaccggggctgtggcctccttgagactgagaggtgatctcgtacccgtgctcagaatccgcggtatcgatcgtccaaacaccgactccctttggtgtctaatacgatttggttttgcgcacgatggatgaagtgaaggcggaaaggttaatactgaagttccatctactctcttgcaaacgacattcgtgcttgtttttgcttttgccgcgcttattctacctttccaaagatgtaaatctgttcgccatagtacaccgcgctcgtgtgttcagcatcgaggctgctcagggagtggaagccatggttcttgtggctgtacatgatgtcgacgggccgcttgctgggacggtcagcgatggagagcttgaaccagccagagccttgagcgcccaggaggaacagagtggtgttctcgcatcggcttccgtggtcgccgtcgctcctgtatttcttgggggtgttgtggtaggtgtagtggtacgggttgttgggcgaggcggccagagtaaggccttcggggagagtgttacggctggttgtggggatggtccatgggaggattgttgttgtggaaagaggagaaatgaggacggagacacagaaatagagggcaggagaagtgttctgttagatagagagtcatattgctgtgcgagggtatgcggcattggtgcgatgttgatacggtgatcaaaagcgtcgaatagaactcaccctagcttgatgtcatggcaagaatacacctgatggttcacgagctggacaccggtcaaatggttgcggtcatgctggtccttccactggatcaccaccgtgtcgatggcctcctcactcccgccatggccagggcgtccatgagttcggtaggattggtagacgacagtcgacagattgggatattcgaacctcagtcgcttggcatccttcttcaccttcaccctgcctccttcctccgcatcatcctcgtggcaagagcatggcctgtcgatccgagaatggctccatgtccgcttctcatggtcccagaccgagaacccgccttcaccattcctctcgaagctagggaccatgaacttgtggtcgctactcaggaagcagtgctcagtgtcaaattggcgcccctgatggacaccacctggatacggaagtgaggtccattgagcgtgcttccaatcaaagccgtcgctctccagccacgcctcggcggggtcagttttgtcgcctttgcggttttcattcttgttgtcacaagctgcagtcgagtcgagaaaattgaaggtgagggtgtttcgagaatcgtagccgatcatataggtgcgatcattcgctcgatcgacaactagacaaggtttctgaaggacgggtggaggttcagagtgccaacgtttgctgagtcccgggcgatccatccggccagggtaggctactgacgccacggaagatgttgtcaggcattgtagagtcagggtcgccatcaggacgacccttgtgatggttgaccgggcgttcgggttgcccattgctggtgaagcgttaggatcaggaagagaggtatcggaacaaaggaattagagaaagtagaactgaggggataggaaaagcagagggggacttcacagcaaaattaaaagtgtgacgataggacaacgttagaaactcaagggtgttgaagcctgtcctaagcaagagcgggagggagttatataaagagttggagtgtacaagaatctcagtggcaaggagagtcgtagctgttcgcgagacgcgggaaataaaagcgagcgagattaagagcaggaaaggtcgcgagagggacgaggtgatcaagaaactaagtggtaagggcgctctgcgcgagaacagagtttacgtgacagaatcaaagtaggatcaagatgcagcaaagaaaaagagagagagagagagcgagatagagatgaagacaggaagacaagatggacggaaggctcattaaaaagggaacccatgcagctgcctgacgacgatgatgtgagctgggaacacagaggggccacagacggctttggctgcagcagcagcggaagttttttttttgcaatccggtgtctaccgtgatggtcaccatcagcatgcttcgctcctgcccatcgcccctcctttgtgcacaggccttaacactcgtgtgctctgtggtgcttccaccaatgcatgggcacacagtgtcaaaagggccgcctgtcccttatttctgcaaccttcgccctcaggtgtaatgcccttgtcacagtcctggaggacctccttacatgcgccccgttatttttggtctttttcatgctaccctctccttgtcgtatgctgctgaggtgtgcctctcattgacctatccagctcctttctatcacctaactcctagccatactgcctgtttgtttgctaaagtctactttggagagtcatgacaggttgctgggttctacaggctcctgcgtcaatgtttgctgctctttcgtggtactaccttgcgtccatccctatccagggggcctctctttttttgagacgattaggtggtgcggatctggccgaaaatgcataatgcatcacttggagctgagtgggagaaagatgatctttatatagcgatgcgacacccctgtcggccatgacagcagagaaaaccattatgactagcacttctcggaccctgttctcgtcgtcatgcatcagcactttttttttatttttttcgcaagtgttctttttctgcctgtcgcgttcatgtgcgggaacatgtttttgtcgtctcctcttgttaaggcgtagtacgcttcatagccagctcctctccttggctcagttagaaatctaggtgttcgtatagaattacaccatcacgtagaatcgtaggcgccaaatcggtgggagatagagtggtgtgaacggcagtggccgctctgagtagtcctagcccgagaggtgcagaccatgctctcgacctgagccttttctaatgtgtgccatggatagagatacgactgggggatcttggtcaaagcatggcccagggtcggtttgctgttcttgaagggtccagtcgtaagggtcataaggacacaaagtgaaggggccaagttcacagtgcaaaaacttggaaaaaaaagtatccaggtaccgctggccataatgcacttttctctaggttgctgagtacctttctatggcccaagcccaccatatataaccatcctcatccgcgcctctcattggccgatcataccccggttcttgccaatgctcgtcgactagtacaaaagtcgtccagatgcggtgctaccggtatcgttggcctcgcccgagcaagggctttcgtccgaacgcttgaatcgctcgtccggccaaattcatcattcggccagaattcgtcatcgtggtccctcactttggctgttaacactttatgatattattcaaaggaacccgctaatgttggtggttcagttcctaactatggtgctatggaggggcagttgaatcggggggctatatataagctaaactaagtgcctgtgaaggcggatctgcgtaccttcgggggtgaagggggtgctaggggggctcttgaggaccaggaggcgcgggccctcactttggcgaacaggtcgattccgctatccgcatagtgaaaatcccccatcgcagaaagaactgcctcacgccatggagcacgctctgaaaccctagggttcctagggtcgaatgagttggcatcaccatgctgattagcatggtcgccttttaaagtttgggtccgctgacaatatcctgctatggatgaggatgctggagcactctaaggctctcgatgcctacatgcttccctcggtaggtacgccaggcacaaaacggcctaatcaatgttccgctactcaactctaatatctttgtgagtcgtaatccatccggctagggagcgcttcctccatgcgcgttcatttgttgggcaagaaagcggtaaaggctctcccgtttctgcaagtgcagtaaaaattgactgatatacacaagggaccgcttctcatacgctcaagcgtgttaatctagggtccagaatccccggatatgatttctcctttgcacggtagaataactcgaccagagcatcatttatcaagaggtgaatattctcccacgccgcaatgccatgcgagtggctgcatcgtacttcgagtgctgagcgatcttttttctacaaatgggaagcatcggatgctattttgccgacacctgctgggcccacaacattacgcatgcaccgtgctaaccgagtcctctccttgctgtttttctccagttggcagcatgaccctcacccaacgacaacggaggtcgtattaaactttagttggacgatgtctgtgtgaccatctgccctcatccctcacccaacaacatcgacctagctttattttgttgtcgtttggcatgtgaagagagtgcgatctcaaactcttaccctgtgagatgtgcccaccccagcgagtgatgctgattgcgaagaaattcataccaacaccatgaaccacctcaaacgccatttcgaccgagtaacgtggtcattatttgccgtctacccatcaattgtatggtatgagtggaccggacagaggggcggcgactttaaaatggttttgtggaagagagaagcaccgatcactcgactgcacaacgagtaaattctgtgcgacgattacatgaaggtaacattgaagccatgcgttttctctagaagactttgaaccgacgaggtccctcgacaattgcgccaaggatcttgaatgtttttcgcatatacactgcaggtcgtatcctcagcagcacatgctgtagccgtttgatcggggaacaaagacgtggacctgcgtacactttacgactcactcacatacccactcacgcagagcgtgcttccacggcgaggtcaaggtgccaagaacagcttcctcagtatgcaacaaaataaacaaaaaagtggagtagttttagatgtcccacctcaagctaatcacgtcctcacttgatacgattttggcaatccagccgaggggtagcttagccaagacgatccaccaggtgcagctgtgctcagtttggcgtgcaggcggcacccaacgtccattgaggacgaacccttggaaggccatgcctcacacttttttatagcttcaattagtctgccacccacccgctctgcttgtgtagcgaaggcagagcaacgggttgggcgcaaaggtctccacaaagctggaaacacacacaggtgttcactgtgcgtgtgtgttgatgattgcggccgaggcttgcaccacgatgattgggtgtgtgcaattgcctctcggctcgcagtgagagctcagcagaggtcagaggcggagacgaagtgagccgaatgaatggaccgggcctattctattaatatggcaggtgcagcaagtaaggtccctcacccacagaggcaaaaaaaggggaatgcgcaattttttttttacagttcctccgctcccctcttcctccacagttttggcttcctgctgaacagaggattctcaacccctccaccttggcacactgacacgcgtacaaattacccccccacatcccaatcgccttacagtactcgcttcctttggactccgttcttgactttccttggtgctctctctctgactggagcattcttttctttctcggactcgctcgttctttcttcctccgttgtcttcaaccccaccttcgctcactcaccaacctctcctgttctcctcctcacttcgacccgcccttgtacagtgtcacctatctataccctcttgtaacatatcccacgttttcatattcacaacgcacttcccacactgttaatcacttccttcacgcccgtcccgtccacctcgctctcaagtccgacaacagtacagatggaggccaaccaagccgcccgccagaagcgtcttaaggctggcacagcttgcacaaactgtcgtcgcaagaaacttcgctgcacagggacacctaactgtgctcgatgcgtcactcataacctcgattgtgtcgttgacgaagccttgttcctgaagaccaacagccctcaaaacctctatgccaaagcatcctcccgcacttcctccacctattcacaacagcactcacatcgctcgaaaggcgccagcagcagccaccacccttaccatcgtcatgatcgcgactctgtctgctcctcctcctcaggctctgctgacgagatgatgatggatcatggtgactctgccgggtttcagtccgaccgcagaatgtcagggagcagcgctacgagcttctccagtctcagccctagtccttctccctccgcttactcctacaactttgtgggccaaagcagcagctacacgcaaggccatcagtcctcatcaactcatgacgcatcctcctcgacaaagcagagaaagcattcgtcgtccaagaaatcatcgtcgcaccgatcagaaacgggttcgaactcccacgatagcttctccacatcgcgtctgttcgattcttcgttcaacgtctcttcttccaccagtagcagctaccctggctcgagctctgctgccccgagtatgagcaaaaagcgggcttccaaggatcacagttcgagcaaacccaagcagaagcgtcgagactctcgcggccgagatagtgatcccggctctccctcgcctctccttgccccacaggactcgccgttgaccagtgcttcatcctccgctggcgccaagaaggagggagaagactacaagtcggttgtgagcacaatgagcctggacggtcatggtcaacagtaagtgacacatctggtgtttgtaatcaaccttaattttcccattccctccccgccctgtcctccatcccccgttgtcgagaagtgcctgcttgcattgccttttcatgccttctgcccttgctgctcttttttcaccttttcatgacgacagagacatagtctgccgcccttgacgctcggctacgtttcgcccttctgctcttacgcagcaaatggttgctgcagcgtcaattatattttaatcagcaatggatgattggatggaactttactgacttggtggtacctctcaccttgcatcttagtttccacggcagtagttcaggcttctatgtctgccagctcagctcccgttaccgtcagggtgtttgtaagtctgttggcattggcgttgaatcataggtcaattctgttttatctaactctgttcttatgcggtcatgacaatcgcagatcccctaccgatggcgcacttgaacgacagcgatctatggtcgcactcgctccaaatgaccagtgagcgtgagctaccgtccaaggcagaaatggacgtgcttctgggcctctatttccgatacatgtacccctttgcgcccatgttcatcaggaagtctttcatggagcagcagcagaacaacaggcctgatctttcccagatcttgattctcaacgccatcttctgtaatgcctgctggtattctgatgatcctgcggtgaagcaggactcgacaaagtacttcaaccgcgccaaaatcattctcgatgagacttaccatgtctcccgtgtcagcactgtccaggcattgctgttgatgtctcatcaccaatatgcagttggcaactactcgggtggctggctctacactggaatggcgacgagaattgcacacgtaagtctcgaccttcgacaaagtggtttcttcaaggtacaagatggaacaattaattaattatttatttattgatcgtcgataggacattggcctgcatcgccaggatgttcaggttaacgagcccgaagaggcagagatcaggaagcgagtctggtgggccgtatacattgcagaccgcctgggaggtggagttcttggacgaccgctgaatcttcgcgacaaggaatacaacgttcaaatgccatcggatgactggatatcagagctgggcggggatgatgcagtcgagtacccctacgagccagagaggattatttcttgccgtcttttgtgggcggtcaagctgtttatgcaaatggggaacgtactgaacgcaatgcactgtatcgaggccgagattaatggcagcttcctggcagagatttctcggacccaacttccacagctgcacaacagtctgacgtcctggtttttgtcactcccgaatgagctcatgtacacgccttacaccatgtcgcccaactcgaatcaccctccctcgccgccgacggcgctcatgcacatgttttactataccacgttgaccatgctgcatcgaccttatctccgccccgtcaactctgctgcaatcgaccccaactttttggtatcgtccaggaatatctgcacggctgctgcgaccaacgtctgtcatattgccgactcgttgatgctccatgggcagcttcgtgacacctgctactacggcatggcttgtctccttgctgctggaaccgttcatgtccataatgccatcacgccaaccccaagcaatcgcgagaccacacgggcgggactttccaaaactgtcaaggcagcacacgagctcgtcaagacatttccagtggcagagtcactgattgcagtggcgctggacgtctttgcaagccagaccagctctgtgccaaccgagatggcagcctcgttcattgacatctccacgtttgtcgctccgtttattgacatgtctcagcttcaatcgacttcaattggcaacatctacgaggcggccagactggccaagctggctaaagatggccccggacccgcaccgtcgatccagctacgacacccgtatggaaacttctctatgccgcttcctgagcaaagcaaggatcaaagctcgaccaatctcagttcgatgtggcagagtcagatcgcaacagccgtggccatggccgcaatcgcctttgggggcactgatcctcaacaagagcagcagttctttgccaaccctctggagttgcccgaggcccttcgcttggcacccatcgatgctatgatgtttcaagttgacggctctagcgggttggacgcctttggaaccgatcccttgcaactaggcaatctacataacagcaccacgtccgccgcatttgctatggcgcagcagaccgattcgcatctgctccagtatcagcagacgccgcagtctcaaccgcagcagcagcagcagcagcaacagcatcagcaaacgcagagttctatcccagtgacctcaatgagctctgtgcccacccagttcagcagctcaacagcatcattcacgacaagtcaggcgctcaatttgatgcaggcttctattgcatcatctctgcaagtcagcgattccccaccgcaacagcaacagcaaacctcacaggtctctcaagctgtgcacacacagcacaccatgatggaagatgataccgcggacccaccgtcgcctccagccatctcctctgatgatatggatatggaagcgtccctgtctgacgatacgcctagcccagcgtcagccagtgccctccgtcaggacgcacagacgcagtgtgacacgccctcaggatattctccggcaggatctgcatcgtcacatgggtcgttcatgtcgtctctcaacgaggatggtgatgatcatggcaacaacttgccgtttttcattgaggaccatgatggttcgctccatcagcacccgcaccagcatcagcatcagcatccgcaacagcaacaacaacaacagcgacaacaacagcagcagcagcagcagcaagtccaaaatcagcaccaaacaaaggaagaatttggttgtcgtaaggatgtcgagaatgttaatacgctgctgtttgacggtcaagtcatggagtgctgagagagcgacgtggtttatgcacatggtcctgctcaaaagcggcatccattttttcgcaagacgtcgagttcgtttcctttcatagcttgcttttttatattatttttttgtacataatcttattgtagtgaccttttaaaaatttccaaatgaatgtgcagaacagccaaaaatctcacttttaccaaggcttgctatggacgacccccgacatcgatttcacttttgaatgtcagatcgctggctgctgtagtctcttgtcgctttaggttggccaaggaagattgaagcgccaattgctcaaacataagcagctgcgaagcagccgtttgtcgcagtcaagcgccactctggattgactgaaacagaacgttggaaagtctgaacaatttttttccccttctggcgtttgtgcataaatgcgcggaccctgcgttttgtgacctcacgaacgataaaaaaaaaaaaaaagctgaactttacagctgctgaggaagcatttcttaagcattaccaactcttctcctttcacaataccaagaaccattctcgacagaaccaatggctaaagacaagccaggcgtcgagcatgactactacgccaatgatccccacagcctcgctcggcggagtagtctccaggggtctgacacctccgcaagcacaacaaaagatcaccctaacgacatacagcgagaacagcagcgccaaaatgatgaccgttcaaggagcaagtcctccctcaccgtcaatcataccgtcaatcataccgtcgcccctcccctggctagcttgcagcccgacctaatcccacccataatccagtcgcctacaaaagaagagtaccaatatgcgacgcactctgacgaaaaggatgaaaggtccaatggttcagatccgcaggccgggcagtctagtgaccctcagcccggttctaaaaccaagaagaaggtcgaggcggtaagctactggcagctttacagattcgcctccaaaaaggactgggtatttgtcgggtacgtgaacaaccgcgtagtttgaaaaaaaacaagcatcgtacctctatttcttcttggtcttcttttgcagatcccatgctaaaataactttttttttcttgggtccaccgtcactagaatgggcatcatctgttcacttggtaagacggaatgcaacatcatttatctgtgattgcgcccaacgcttatcaaatcctgcaatatgcggcacccacttttttatttcttacgtatctttagttttgggtgtcggtcaacccacggtagctctcctctttggtaccattatcgcagacctcaccgatggcaatggcgataagagcgaaagggtggttcacacggtgaccctgttcacgatcgtgggcgcggtgatgttcgtggctgcttacggtcaacaatgtttctggaccctatcagcagagcatcaatccaagcggattcgggagaaatactttcacgcgatccttcggcaggacatggcctggcacgacactgggcgacagtccgagtcactcaccacgcgactgagctcagacacacagttgatttttgatggtttggctgacaaggtcggtctgtgtctttccaactttaccacgttcattgccggtttcgtgattggattcgtcaagggctggaaactgagtttggtgctcatggccgcagtgcctttgatcggaggtaagactggttcctgcgaggtcattcgtatccatcagtttgttgcgtgatgggttgtactgaactcttgcttcaaaaccttcctcatagtgaccgctgccttcatggccaagtatacagtcgagagtgcgtccgaaggacagggctcctattccaaagctggagctgtcgctgagcaagcgatttcatccatccggacggtggtggcatttggagggcaaaagcgggagacggcggcgtacatcagatggcttgatgaagcgtacaagtctggcgtgcgcaaggctgttactgctggacttgggtaaaggggcatactgttatgaccaggggtgtttttcacagcgaggccgagttagcgctggcgagaagcgatctaatggatgtctccgctcgcattcatatatattagaaatggcatcttcttgtttgtactcttctgcacatacggtaaggaaatcgcctgatcggcgatattgtccaaaaaactaaacgctgacgcgaaactaacatgttcacacgtttgattcatgcggaatcataggtttggcgttttggtacggcgccaaccgcgtgtcagctggggaaatgacctctgagcaggtcctgaacgtgtttttgggcatgattattggagctttcgcgttagggtaagcgtcgccatgcctcatccacgctattgataccgctacaaacatgatggggttatcctctctgtgacagtttcttttcagcttctaatccttaatttccaatgcagcaacatcggacccaacctgtctgcattcgccaatgctcgcggagctgcctataacattttcaagaccatcgatcggattcccaccatcgactctgctaacccaggtggagccaagcccagtaacattcaggggcatatcgtcgtgcgagacgttgatttccactacccaagtcgaccggacgtaccaatcttgaaaaagatgaacgtcgaagtgctgcctgggcagaccatcgccctcgtgggtcagtctggaagcggaaaatccacaattgtcggactggtagagcgattctatgaccctattggtatgtcagcccgtcccatattaccttgtttttgtttctgatgcatgactgaacactcaggtcggatcgtgtttctaacagtctttccttttgacatccgtagccggatccgttactctggacggtatcgagatcgaggattataacgtcacctttctccgtgactcaatcggaatcgtctcgcaggagcccgtccttttcaatgccagtatcaaggagaacattgcactcggtgtgcgcaaagaccaggctcagcccacagaccaggaaattgagcaagcctgtcgcttgtcgaacgcacatgactttatatccaagcttcccgaccagtatgacaccatggtcggagagaagggagctcttctctcgggtgggcaaaagcaacgtattgccattgctcgtgccctgatcaagaacccccgcattttgctgctggatgaggctacttcggccttggataccgagtccgagaggaccgttcaggcagctctggacaaggcttccgccggacgatccacaattgtcgtcgcccatcgcctttcgaccatcatgaacgcggatatcatttatgtcatggagaagggcgtggtgattgaatcaggaacgcatagatctctgctcgagaaaggaggcgcgtacgcggagctggtggcgaaacagcagctgaaatccgagggcacagacaaggacgagggagcagaacaagatgcacaaattgacattgatgaggtcccagcggcctcggcctcccaagcaccagagatgatccgtcgcaaaagctcaaacaaattggcgagagcattatcaaagcgttcgagcatcatgtcacggaacaaagtggactcgtctgtcgcgatcgaggatgaagctgagaatgaggcaatggaaaagaagcgcgtcaaggatcagggagcgcttatttttcgtgtgctgaagattatgaagccagagataccgatggccctttttggatgcgtcatgagtgccatcgatggagctgtaagtacaagataggcatgaatacgaaagagagtcaagagtgctgagttacgttatcatggcacactcacacattctctcttttttttcgtgtgtgctgaagatctacccagtgtttggaaagatcttttctcaaatgctcaatattttgagagagccagaaagccctacttttaccaaggactccaatttttggtccctcatgtttgttgtgattgcggtcgtcgattttttcgcggtaggattatccgtgtacatctttaatctcattggcgagaagatggccctcaggatgcgcaccatcagcttcaaggccatcctcagtcaggaaatggggttctttgacgaggagagacacagcactggcgcgctatcatcccggttggcaagggacgcttaccagatgcacgaactcgtgtcgcagctcttgaagaccgcgtgttccacgttggctatcatcattatcggtctcgtctttgccttcacagcaaactggatcctgacgttcatcatcttagccttgatcccgctcttgggaatggctcaatactacgaggttgcagcgttaactggattcggccaaaaaacgcaaaaagcctatgaacaatcaggaaaagtagccgcagaggccatcgccaacattcgaaccgtcgctgcattggccaaggaggccaactttgagggaaaatacgagtgtaaggacctgcagtgcatcgaacgttgaatgcaaaaatatgatatcaagcacctgccaccgtagaactgacaacttgttctaccgcccttttgatgcagtcgtcacccgaaagcctcacaaatattccttacacaaggcatactttgcttcctttggatacgcgctttctcaaggagtcatgttctgggcatattctgttggattctacgcaggctaccgactccagagggcaggccgtctggaatggtccgagatgttcgacaccatgtttgctgtggtgtttatggccatgggaatcggccagatggccactcaattgtacgtttcccttggcgtcttgttcgcgtacacttgattcatcttctcacatgcagcaaaagatactcattccacttttatactcgcatcctattcaggccgcggtatgtcaagggcaagcagtccgcgatcaatgtttttgagctcctggacaaaaggacgaccattgatgcggagaaggacggagttgagctcaatcctctccagggtcaagctgcccttgaaaacgtcgagttcgcatatcctactagaccggatatcaaactgttcaagggtgtcagtttacaggtcaatccttcccaaacagtggctcttgtaggtccgtctggatgcggcaagtcgaccatcattgctttgctggagcgatggtacgatgctcttggtgggcggactttagtggaccgctacgacgtcaaggacttgcagttgagccatctgcggtctcagatggcccttgtaggacaggaacctgtcctctttgacaaatcgatcggcgagaatatccggtatggaatcccggatggtcagacagttgatcaagagcaggtcgttgcggcggccagagcatccaatatccatgactttgtcatgtccctgccccagggctacgatacccccgtcggagacaagggatcccagctgtccggagggcagaaacagcgaattgcgattgctcgcgcactgatccgcaaccccaagattttattgttggacgaggccacatcggccttggactctgaatctgaaaaactggtccaggaagcattggataaggcccgtactggacgcacaacgattgtgatcgcacatcggttgagtacgatccaggatgccgacctgattttggtggtgaaggacgggtccattgtagagtctggtcggcattacgagctgattggacttgggggtgtttatgcagacttgtgcaaaaagcagaatctcgaggtgacacattagagcgacgctttgttttacatcgacgctaattcaataaagaagctggttcgtgttcttcgggaaaaggttttagatgctcgtgcatcgagcgaaggggtcgggggggtgatctgtgctctcgtaccgccatggacgaccctttatgtctttgtcctcctctcttgtacgactcaattgggtgagaatgaacagctgggctatcccaccttgcgatctcgccttgaacagggatggatatagactatggcgttttgtttgtgtgcgttttgggggatttttttcgcgtatgatgttttggtgactacaatgaagcgagcaggaaggcgatggcccttttttctcgcttcgatggacaaagcattgttgaggatgagaggaacgaacaggctgcaaagcaaggattctcatggttttcatgaacctttttttgtggaccttttatggaaaccatgccctcctctggacccgctttcttgctcatgttacagaagcaatgctaagggggtgagttgcggcgcggttggaaaggtgccaaagcttgctcggcaacgatcaataatcgtcgagaggaccttttgcgagaattgcttagcattagctggaagggagatgtggcaccatgaaaagcgaatgaggagccttcaattgcactttcagtactgtctgcagtggaatgctgtaacacggtgctcacaaaggcaaggacaggggttgtattttttcccttgaccatccaaaccaataacggcacgctggctctcgctgagttgggctggtgatcatgtaaactcaatgtgtattgtaagagggtgatgtcctgaaataacaccgggcagcagtgagcaatggacttgtggtcactgtgcggtaggtcttgataccatgaagagcgttgcgtgttcattgccatttccagctcggaaggaggcctctttgtttggtgctggcaatccgcgatcgcaatttgttttatgggcgagaaattctcccagatagacgagggagagagctggcgaaccagccgtgggtacacttgctgatctgcacctcctgaactcttttttcgtctctctccttcctggaacatcgctttcgatccatcttccgccctcccctcttgcctgcaggtccgcttcgcttcattcttctctgtcaccctctgacacttctcactcgttcgctgttctatcccaaaagcgagttctataggacagacacgaagcgcgcgtctgtctcatccgcttcagagacaggcctattcgctggcggggtccctttctcccaccccccgacggcctctgaacacaagcgcattctcgcataagaccgcacactcgacaacgcccactgctgctgctgcataaaaagacaccttgcagtccttctcgccattccattccattcaacacatacacactttctgattaccaactccactcgttctcattcgcattcattccactgccacctgctctttcgttgggcataaaagagcactgtgtactcggcttcctcttttgaacgcaaccacttccgcctctttcccaaaaaaaagaacactagactgaatacgcccacggtccccccagaacatcacgatggcgtcgacaaatacacccaggaagggtgggctcccgcaacatccgtcagaaatgactatcactgcgctggatagcgagaacactccactgttgtccaccaacagagagggaccatcgtcactcggttccgcagccaacgtcaacagcaacagcaggcaacacggccaaagcgagaccgactcaaccctggagtatgtcaaggtcatcaaccaattccttccatggtacaagcgcccgtcagttctgtggctccttcccatctttgggattacatggattagtaccggcatgctgcagtcgtccttgggccagtttaaagcagcgttgctctgccgcgagtacttgaaccgccacacgtccaacacgacgctgatggcaacggagggcgtggcctcgtttctcacgcacacttcggtgcacgccgtccatgggctgagtcaagtgacgactgcgttccgacctgcgcccgaatgcaaggtgccagagattcaagcattcacagctaagatcttgggccttgttgaggtggtggacagcatcgcaagtatgtatccgtccaaatttcgattcgatcgagtttgtgcttcatactaacggtgcaccccctttccttcttcttatgcatcgcaactaccaggctccctatcggctggatactatacctcgttgagtgacagacatggacggcggatcatcattatcatcgcctttttcaatgcctttattgtcctctgtacccttgtcgccatggccgcgtactgggagcagatcgggctctctctgatgatcatatcgggacttatcaacgggctattgggaggcaacttcttgggtctcaccatgagtctggcttatacagccgactgtactgagccggcgaagcgcgggctggccttttcttggttgcacgctgccctatacctggggttggccattgggtacgtgcctctcaagtcacggccgccttgtctcctagtcagacgtagtggcagtggtcgctaacacgtactttgttttcatgggttgttaggccgtatttgggtggatccatctccagggcatctggcacgattcttacagtcgtggccattgacatagtcgttacattgattgcgctcgtgctcgttgttctgatcctgcccgagtccctgccagcgaaacagcttgcgtacgttcgaaagctgtatccccagctcaacaagagggacgaaccttctgtcggtactcaagaacgggtcccatggcattcgcatgttgtcggctcccttgccttcttcaagcccaacggccgcaacaccaacctgatccttttggcaggcatatcgtcgctagcaatgctggccttcaagggcacgctctcagtcgtcatcctgtataccaatcaagtcttccagtggacagagtacgaggacggcatcatgttctcgcttgcctcgtttgcgcggctcattacgattcttatcttccgcccagtcctcgtgcacttttaccaaaaggccttccacaagaaggtcagaaaggcgcgcgcccaggccgcaaccgctggtcactctcaacaaaccccaccgtcacaaccaccgcatcgttctcgctacgacgacacggaccggacccttcccattgtcgtggacccttatgacgcgactggtgcaaccagtgtccagcatctgggcaaagccgcacttgacctctcctcggacgagagcgagtcggtcgaagaagagtccttcctggcacgccgacagcgccaggaatcagtcgactcgttcaccacgctgacctctggccggccccgggaacaactccatcgctctccgcgttcatactcatccaacgtcagcacatccaagaacaaggacaaggcatccgagcccacagtcgtgacggatgcatctggcaggtcgcaggaggagacttttagcgacatgaagtttgatacctggatgatccgacttgggttcgcgatcaactctgtcacgtacatcgggtacggcctggcgagcgagacgtggatgttctacttggccacctctcttcatgccgtctgtatcatcgcgacgccctcgatcaagtccttgctcacccatttggtcgagccctcccagtttggggctgccttgggagcgcttcaggtcgtggattcgatcgcggcgattttctcacctgtcgtgatctcgtgggtgtacgcgcttacggtcaagagcatgcccgagtttgtgtggtacacctgtgcggcttggacggccataggtgtcgtactggccttcatgatccggcagaagcagttcaggaacaatgcgatcgccgtctgaaggattttctttttcattttgctgcaaggaacaagtctctctcatttgtataccccctccttcactccatcacccaccctttgctgcatattgactatgctatgatgttactttttttaatgacaattttatttctcttgttgtatatactcattgcacgatgctgcgccgtcatgcaatcgcattgaaccctcaatccgcctacactgctgttcgatcaaaaaaaaaaaagaataaaaccctcaatcttgcagatggaattctcacaccaacagatcgaatccagaatcccggcgcacatccgccacggggaccttattgccgtgctggtccactgtgaactcctgcgtcttccgatctgcctcacgcgtgctgctggaattcttttctgccgcgcctctgaattttgtttcagtgtgtggcgcatcatgcggatggacgcgctggtgctggtggtggcggtggtgtccgtgcgcgtcgctggaaggaagagccgtgtcagcgtgcacagcaggatgagtgtggcgcgagccatcatccacgttctcatcatcatcgtcctcatcgtcctcgccatcattgtcgtcgtccgcgtcatcaccactgtcatcttccaaaaagtaatcctcgttttcgcgttcgttgtgcacggactttctgcgtgactctgaatgcacctccgtctcgcctccagtgccagtcgcgtggcttttgaccttgtcagcgtaggagatggaggcctttcgcagcgtttgatcagccaaaccaaccgaagagtcatccacatgatgtgagctggacgcagggacctgtgtaccagccatagcagccacttcagcaaaggacttctttcttggtgcttctgctactgctgctgcaactgctctatcgtcatcgtcttgaatgatatgggaaatggcttggcgaatgccccacgactcgccttcatccgactgtccaagaatgccctgcccctccaagccgcctgttcgcatcgcgtggtcaaacgactctttgagctcctctgtgaaatctactcaacgcatgcaaaaagaccaaaatctatcaattttcaacatcttcctggctgtcagcgttgcgaacatggcagggggtagagtccctcagtggcaatcactcacctgtcactgaatccggcaagttgtccttgatgagactggcggtggactctgcggtcgaggccaaagctgccacagttgccactgcggatccaaggacgccgcccgaaaatgcatccatgtttcgaaggagttcactcccatgaacaaagcccaaaatccgggatccaagatctcgaccagccgtgttatggtcttggtgctggtgcgcgtgatacactgctgccggtgttcttgacggctctgacaacttcaagtgggtggtgctaggaggctgtgtgcgtgttcttagcggcttggacttgacagcagtgcgaggctgagtgtcggacacgtcttgaacaggttcgaaatctccttggtgtccgtgcacggtcgttgtatccgcttcacgggtcgctgtcgccacgggggacgcaacggcggcataagagggtacattggacttctcgttgctgaggctgggagcagaagcctggggctgtaacactgttggttccgggacgcccatctgcctctcaggttcgaccttgctgttcaaggcacccttcgcagctgcagccttttctgcccttctcgccttcttggatgtcttggttgtgggggagataacggcatctaacaaaagaataacgagcggggaggttgttagaagaaaacaaatacaatctctggggattctgcatctttcaggcaacttacggtcagcttgacttccggaggtttccgcggcggcactctgaactgattccacgtgcccgtgaatgaggttgccgagtcccttggctgcgatgttcttaaaggatgcgtgttccatggtttcgccaccataaaaccccttggctcccaccagggagcctacagagttgttctcaagttgatcgttatctctgcgtaaggtcgcacctttcatagcagctatcaagtggaatgggtggacaagtattagttttcctatggctcaggcagcgctttaagagttacacgctgaattctgccctcgtaccgtaaatatcaattggcttgtagttcatcgtttcgccgccgtaaaacccggtagaccccaaaatggctccccaggaactgagattgtagttgtctccccgagtatgggacgatatcgtttgaggttctaagtttataaacaaagcagaggcaaggattgagcaaaggttcaccgcagtcgaatggcagagaatacaggcctgtcgtcattcattacctatatcttgggcgcttcctcggctagatgatttactatgatcgcccttcttgggtgatgcctttgaggaacctcctgctccccgaacttgctttgtcgtttcacctgcctggttttcttttcgctgagcgacctgatggggatccgctttccgtgcaggcgaacgcggatcatcgtccgatgtatgaccagcccctttgagcgcacaagcggtcagtatgaggagaatcaaaggaagggcgagtgtcaaaagtataatcctgggatcgatgttgtaagtctctgagaggtgatcgagtccgaggcggtgctgcaacgcttgaacatctggcgtgtagttccaaaggatgttgtcgaacgccatggaaggatcccactgcgtccacatggctcctgggttggtgagagactgaaagaagctcgagagcatatggtgtgccgaatccctcacattgtcgctgtcgcaaaaactaggtgctccatcgtaataaatttcgtttgctggaggttcacagacggtttggccgtcgtgcttgagaatatcgacctgactgctgctgaggctacggagatacgagttgaggtaggatgcagcttctgagatggccgaagagactgcagcggcagacggagtcggttgagtgtggctctggctctggcttttgtactggtagccatactggtggtggttgtagtcaaacactctgtagtacaggtcgtcgagggagttcttgacccgcgtggcgaagtcgtttggcatggtcacggtgatccttgcatgcaaaagcgctgtatcggctgggaaacggaagcaggagggcgatgagtagcgtcaaggagaaagagtcaaggagaaaaaatcgaacacgagtgtcgtggctcgccatgcgagacagtgtccgcgcacattattggctgtttgagtcgcgccccttcagccagccagtctcacttgtcctcgtctctcagcgctgttctcgtccttgagagagcagcattcctcgcttgcgggtggcactgcccacagaacataggctttgcggtcgtactcgcagtaaccgtggctcccagcccgtttcacggcctctggcatgtcctcttgcatggtgaacgcaaagccctcatcgtccctcaagtcttctctgcattggcgtgcgatttgttattggccaaacctccagtcaacaaaggaaggataatgcaacgggcgcgattgacggctgcagcttctgccacacccatccagtcatgatacgcccagcagacattataacaacaacatcttggtggttccatacccgagtatttttttccctctacttttcacttttctcccagcacaacacccacctccttcacacacgcacttatcatcctccaaggatccaattcaaactcccaaacatgcataccgctcgtctcctcaagcagtcctcgcagggcatgaagccaccaaaggatgtgatgccactgatcacctttgtgtccgcgggtctcatcggtggatcctacgtggcctttcgtaagctcatgaccgacccacacctccgccatcacgtccgccgcaccattgagtagtttccttctgcacgcaagcgtgtgctgactgtatatacataacgaaaggtgttgaagaacgattaaaagaacactttttttttttggtttttttttattttgaagagaaagagtgagaaggagaggaggagagactgcaggtggtaggccaataatccgcattgagtttcagccctcgaaaggacctacagcgtattggacttatagaagctgtgtgctagaggccgatttcaatctcgctttcgtgccccgggaggcacgaaggagaggattgctggtagccagatcccgccagcgactggctggcgtccccgctaaggacagttgcgcacatacgcggactttacccgcttgcagatccacttgctggatcggagcgaacgaaggcccgttgcacaacagagatggtcagtctctctcatgcaacgaagcgcatccatcctcgccgtcgcagccgtaatgtttccaagcaaacgctattcagcctcccacgaagcagtctagggtgcgaaaaattcgctctcgggactgcgctttgtagccgtgggaccgcgctttccttggcgcactcttacgcccagagccgcagcgttgttctaagggtcactgtgaaatagctcgcatctggttggaccaccaaaaacccaccctgctctttaacagcagtcccttctgcaccctcatcattcatgcacagatgtgattagtgatcttgagatgaaggagggtttatttttgcctgaacaagagcaggtattataaataattagatagacggtagtgaatagtacaagaaaagaacggcaaaagaaaaagcaagggcactagcaaaaaaaaaaaaaatctggtcgatcagtccaccagctcaaactggacagcccaaaagatcgtgtcgccttccaaggtcctgcacacatagcgcacaggctgaccagccagatacttgcggatgttcatgctcagacccatccggatatcaaacgtgttaaagtccatgtggggcgagaaaaagtcaaagccgtggacaagatccgtcttgtacacaaagtccttccggttctgctctgtctgaaagtgcttgcggcgctgtgaggtcgacagactgttcttgtcaggcatgaagaacgtcgtgtcctcctcaacgaaccggcgccagggacccagaggcatgccctcgtcattgtgctcctcctccgtggacgaggcggtgagcgatggcgtctcaggctggggcgtggcaggagagaggatgccctgaagtccgctcgcgcttgatcctgcagcaaccgctggaaccggtgatgcgataccgttgttctggcgagtcttgtccttgtccttgttgtctagttgatcggacgagttgtttctgctgttggcatagctgttcagaccactgttttcgttgttcgaggctgtgctcatgaccgaagaccggttgccgcgcttgagcttgcccaagaatccccatgcgttcgacactgctcccgtcacaccattctcagtcatggtgaaggcgcgtgagatgtccatggacggtcgaggtgtgatgggtggtgagggcagcttaatattttcaatcgctgcatcctgtgggcgccaggcggccatggtgttgatcgaggagaccaaaggactcaggatccatggcttcccatccttagtgagcgacgtcttcacgacaggatcgatgtaccgtgcaatcttcagcatcatctcgaaaccatcgggcagctccacagaacggtcaaagtctgtgccgaaatagacctgttgaccatcccactcacgcttgaatcggccctcaacctagatatttgaggttgggcatgatgtttagccgaccacatccaattcgcctttgcagcagaagaatacaggcaccacaaaccggcttatccaatgactaacctgaagtgagaatcggcgattgtgtcctttgagatactctgagttgaggaccgggtcagagtcgtcatttgtgattccgactggtatgatatcaaaggggcgagtatgtccgcggcaggcacgtcggtagagggaaggggttaaaatagaaatcagggtgacaaagaaacagaaaaaaatgagagagcattcaggttagtgttttgtccgaagtgagggtgtggagtctgctgcagtggagtatgaacgagattgggtacagcgcgcctgtttgcacaccttgaacagaaaaattaaaaaaaagtaaaaaagttgagagcagttgccagacacagcacagagaccatgggtcagggaacggcccgctgctcagaaatcgcagtgccccctttctttttctgtgccaagccctgcctgttcctctgtccgcacggctgttgtctgttgctggtgctctctcgcctctgctgcccaggtcacacccatgacgatatttgatgtgttcttttgtacgagcctggtctgtcatatgcgagagcagagtccgaggcagaagggaagatggttgaaattgccactttaagaacgtcggctttaagggaggctgcggtgcgaggttgttgtagtggcacaagacgcgagcgagctaggtcaaacgagtcgagcgcagagtcgacctcagccaaagcaaagccctcactcttcgcccagtaaattgccagccagacccatggatcagcgccaaagccaaagggttgccgtatgggctgatatttcttttgtccatttggcaaggctccttttacccccttgtcgcctttctcctagagggtcgttggggacttttgcaagcttggaagccccagtctctggtcgtattaagctgtctttcaccgcctcttccgtaaattgagttataaaggatgcgagggggtctcaacgatgcatatgcagtataaacggtgaatccgctcactcccctttgaaatcagagagagagagagagagagagagagagagatagagaaagacatcgagagaggaagggaggttgcatgcacgatatgcagcagttgtatcgtctcaggaaagtaaccgcccgcctccttatccttaccaaagtccctgatccgaaccatggcgcggcccttgaactctgggccgtcaaactcgatagggtgggcctcatcattgcagttaacgatggcgagatccgtgtacgatccgccgactctgacacgtagcttgaccataatgagaagggtatatgggtgtaaaagagagaggccttgggaggctagttcgggaagagtggagagagcgagagagtgagggcgaggaggagcaaagagagtgaggtagaagagctgcttggcctataaaccaatgagaatgagaggaagaggaatgggaaagagaggagaaggtcgagctaatgttgaataagatgaatgagcaaaaagggtgcagagtcgtacgatagtgcttagtaaaatcccgagaaggttgaagtgctcgtattgctctctctgacagtaggtcaggtccagcgagctgtagagagatacaaagcaatggcttacttatgcaggccagagacgtatgttgggttgctgaaaagtaagggaagtgtgagggcgggagtgaagttgagagaagagattgaaagagagtcggcgatggtggtttttttatattctgcgctgcacatggtccaggctgaataatggacgaaatcatttttgagagcaaagcgcagctatcagcctgcagaggacatctgccgcctgtgcccaacacaccgcatggccaaggttgcacgccgttgcctcgctccgtgcctccagcctgaccccgcacgcacacctttcctgactctttatcgctcggttctctctttccctctttttctcggtcgcatccccctccatctcatcgttaacaataacggtgagttttttttgccaaaagaccaaagaaaaagagggggtcagtagtgggccactccatcgttgtctgcagaaagataggcaacggcggctccaatgatggtcaagtacgcggacacgggagcggcaggggctgctgctgtccattcaagagcgacacgttcgcgcagaggtatctttttagacgcgagccggccctgaagacagcggactgcatgctggccaagacagtacgctgatttgctgtgattcgccgccaaaactcaaaacatatatggtccagccacctttcaaaatgcctcttgacggacgtgtccccgcatcgaagctcggaccatggcatgcatcttctatggccctaccgagacggatcatgcgttgcgcgcaacagtttgtcgtatttgcgttgattccaaacatgctgcgaggctcaggccactccagcccagaaaacagtcaccggggtgtgtgcacgcactcgcgacattcgtgctttttcacacaccatgcagcctggcatccttcctcattgtccttgccagttttttaccaggaaacttctgaaagctccacggaagcacgatcgcagataaaaaaaaacagtgaagatcaagcgcggtacacaggcctcttccgttcgacaaccgtccttcgagcacccgtatggaccctttggagcactattgggcgcctttcgttgggctgtagaaccttctcctatgtactttggctccgcagttctctgatataaattcccatcagcttcctctcctctttcctctgccttccataccactctaatccatcaacatcgctctatctaaatcatggatcctcccactccgtggatgtgcccggatcgctctgctaaattttatgagaaaggcggccctgaaggctgggtatgttggatctcccgaacgctttgttcagcactggccgtcattgtgtgtttatcaattgactggcagcagttttgcacgctgttaatgaaggggtttgaacggtgatcgcttgtagggtcctctcagtccagatcgaacagatttcacactgtgcttcgaatacaggcatgtttgaacgtgctctttactagcgttgactgaaagctcattgccatgcctaacttgttgagatgcgcttttagtgtgatgtatgctgccactgcggctgtcgcgctgctggtttttactgcccgcatccatcatttacgcaaaggacaccagccccatcacttgggccgcaccgcatggatctactggcccacgcaagggttcatgttcgccgccagtagcaccatgatggctcaggctatcctaggtgtcatgacagggtcctcctcagcgtacgtcatcggcacgctgctcatgggcacagcatgggtaaggagagggcaacacattgcatccgtcatgccgtgtgaggagaatttggaacactaacctgttctctcgattgaatatacacgtcagctatgcgcgctaccgttgaactaccacgagcacaagtacacgatccgttcctccaactctattctgtccttcttcgtgtcctcaatcgctgtcctcattgtcaaccttcacacgctgtacgatctcgaccaaaccgctcaacctccataccgactcgccattgcgaccctgatcctcttggcactgggatttgtggtcgaggcttggccaagaggatcgacgtgtgtgcaacagcagagtggggctcaggcgtatgagaaagccaacatgttttctcgtctcagcatccatttctaccagccaatcatctctctggctgccaagaagaaactactgataccggatgatatcgtcaaccagttgccagagaagcacaacacggagcacggttacattcgactggcagctgcttgggataagaaggtgcagcgatatgagctgaaggtcaggaatgctgttgctgcaggagacagcgatcgcctccgccggatcaagaagccctcactcttggccaccatcctcatcacccaatggagggcgttgctcccagtcgtgctactgcgtatcatcatcccgttttttgaactggtccagccggctctgctcggtctcctcttggactacatacaagggtcctcctccgatgaatccgccaaccagtctttgacacaggcttccaaggcaggagcaaacgaggcgaaaacgttgagctacggattggccctcgcacttgccatgtattttgcgagtgccatgacctcagttttttatgccgactttctgcggcgcacgggactcgtgggcaccgagacaaagtccgcgttggtgggcatgatctaccggaaggccttgaggctctcaccggatgcaaagaaacagtcgtcctcgggtgcagtcaccaaccacatgtcggttgatgcgacctactatgaggaggcattcgatcaattgtccacctggatcactctccccttctcctttatcctgtgcttgtaccaatgtaagctgccggggaggggttttttatgctgccgtctcacctcaagtctcagacctagtagctaacaagtttcgttgccactgtagtgtatcgactgctcggctggagctctatggcaggggtgatcactatccttgcctttgtcccggtccaggggtggcgtgccagtgtctacgagggcttggaagaaaagcgtctgaagaccacggacgagcgagtccgtctcgtctccgaggtcctctccaacatcaagattgtcaaactttacggatgggaatctgccttcaaaaagtcgatcctggcggtcaggaacgcggagctggggatactgaggaaacttggaattgtggaggccatcatgtcgctggtgtttgcgtcgagctcgaccattgtcagcttcgtcacgtttacggtctatgtgaccgtcggtcatggagtcttgacgcccaaggtagtgtttgtgagcatcacgctgtttcaaatgcttcatgggccggtcgcccgactggcggaagtgtaagtgcgactggtgtcattctctatttctctttcactctttctctcgctgcatgtttcagttcagctcaaaagatctaaccattttcacactcactgctgatgcctataggacgacagacactatcagcctgatcgtcgccacgaggcgtattcagcggttccttttccgagaagaaattgatgaccaccaaatcattcgtgagaagttggatgttgatgccattggccaaaccgcaatcgagatccacgacgcaacattgtcttggacctctggaaaaccgcttgtcaaggatgaagacgacgaggatgacgaggaggaagagcacgaagacgatgatcccacagagcgtcaagacctcttatcgggccatggggatgttgaggtcgttcacagtgaccaaccgctcacgcccgcattccagaacctcaacctcactatcaagcacaagattttgacagcggttgtgggtcgcgtcggacagggcaagtcctcgcttttgagcgccatcattggcgagatgtacaagctgcaagggacgatccgggttcggggcgaggtggcatacgttccacagcaggcctggattctgaacgcgacgttgagagacaacatcctgtttggaaagtcgtttgatcaagagcgataccgacacgtgctcgacgtgtgtggcctggagccagatttggccatgcttcctgctgggtaatcaacgcgcattgcttgactagtcccttcgctattttttgtcttacttactctctttttttccatcggatatcacgtcctaattgtgtgccaacagcgatcagacagaaattggcgagcgaggcatcaatttatctgggggccagaagcagcgcgtctcacttgcgcgagccacttatcaagatgccgacatttatctactggacgaccccctgagtgctgtggatgctcatgtggatcaacacctctggaacaacttgattggaccacagggacttcttaaggataagaccaggatcttggtaacgcatggcatccaccacttggatcaggttgaccagattctcgtcatgagaggcggtgagatcgtagagacggggcactatgaggagctgatggctgcacagcagtcgttccacgagttgattaaggaatactcggccaaacactctcgaaaacgcaggaacagccatgcggttgcgggcacgtccccgtcatcgtccctagcggatccgaccgtgggcgatttcagtctggaggacgcggatggaagtggagcagagtctgacaatgcgaccattgaggagtcaggcgtcagcgaactattggccaagaagcaactcaccacggcagttggggatgactgtgcggaggaggaggaggatgagctcattgcagaggaggccatgaagaaaggtggaatcgaatggaacctcgtcaagacttatgtcaaggcagcctcggtcccagtggttgtgacaatagtgctgacgtgcattatcccggagctgtgtttgatggggacgagtctctggttgaagcactggatcaccaagacaaaggaggagctcgatagctcgcttgtgctgtttctgggggtgtatgcggcactgacgcttgtctttgtggtgctgtacgtcgtgtatctgtacttgattctggctgtggcacgcatccgtgcgtccgagctgatccacgagcgcctgctgagcactgtgctccggttgcctatgaggtgagtctcgcgtcgtctttgttgtccacacacgcgtgcacatgccacgcgcgtcttctttcctccacacacgctgcttgattctcccacgtcttttgtgtccatccactcactcacacgcccatgctcatgtcgttgctcttaatgctatcagcttctttgacaccacacccatcggcagaatcggtaagtgctggaatggcatgcctctgattgccacatgtacctcaggattcagccaagctcactctcactcacgttcatttccatagtgaaccgcttctcgagcgactgttttagcatcgacgagcatctgccatggaagtttttggatctgatcttcctcgtcgtgtctgtgtccattaccttggtcgtgatcgctgtcacaacgcccgccttcgtcgctcttatccccattctcgcaatagtctactacttcattcaggactactatctgtgggcgacccggtccctcaagcgcatcaactccacctcgctctctcctctataccagcactttgacgagaccctaaacggcgtcgccaccattcgcgccatggcggtccaacaacagttcatccaggaaaacaccaagcgcacggattttcactcgaacgcgttcacggcctacaagtacagcgaccgctgggtcgagctccgtctccagtggctcggttcgaccatcatcttcatcatcgcgctctcgggtgttcttggacgatataccctggatcccagtctggtcggactggcgttgaagtacgcgatgggcgtgacggacgagatcatgtggttgtgcagggacttttcagagtggcaatcgcatctggtcgccatcgagcgcgtgcaagagtacacggataagcatacagaggcgcctgaaaagctcgagaggagcgtgccagcgcagtggcccgatcaaggtcgggtggtgttcaagaacttttcggcgcggtaccgtgaggggctggatttggtcgtcaagcatctttcgtttgaggtccagccctgtgagaagattgggatcgtcggacggacgggcgcgggaaagtcttccttaacgttggcgctgttcaggatcattgaggcggccaacagcgactgggcgcgggcgagtgacaacagtggataccatggatcgaacaaggacagcggcaatggtgtggatgagcgggagccgttgctcgcgcagccgtgtcgtccgagtgatccggatgaggagatggacggaggatcgatcgagattgatggtgttgacatctcgaccttgggcttggcggatcttcgacggcacttggccattattccgcaggacccaaccttgtttgcaggaacggtgcgtagcaacctcgatccgtttcaggaggccatggatgcagagctgtgggcggccctcgaccaagcccatctcaaggacgctatccgccacttgcctggcggtctctcggccgaggtggctcagggcggtgaaaacttttccgtgggccagaggtcgctgctttgtcttgcccgagcgctgcttcgaaagtccaagattctgatcttggacgaggccactgcggctgtggatgtggagacggatgagctgattcagaggacgattcgagaggttttcgctgacaggacggttttgacaattgctcatcgcatcaagacggtcatggacgccagcaagattctggtgatggagcaaggccaggtggtggagttcgaggcgccaggggtgctgctgcagcaaccagagtccttgtttttcaaactggcccatcaggctggcgaggtggccctgtaggagccgccgggttgggtgagggctacagttttcaaaacatggtcgcacgaaacgaacgtacacatacctagatcgacacgtaaaagtactcggggatcgttcattgcactgaacaataaaattcctcttctccaagggtctcctccaagggtcatttctggatagtcagccgtaatggatctaaaaacaccccccctccccccctctcaaatcaatcctgtttgccctggctcaggatcgcccaatctgatttgcctccctgcgctttttcatttttttccgttctcggaacaagaagtagactaagtaaaagaaaggtaatacgccttctgctgcgcgttgatgatcgtccttctgtaacgggtatgtcaaggcgtactatcccgaaaatcctgctgtcgtccactacgtatttcgctcacggcatactttaaatcaattaaaagaaaccgaaggaataagggcaaaacgaaactcccttggaaaaaatcagcaacccattatttgggctattgcgaattgaacaaaaactccaaagaacgggcatgcgcaaggatggcggagctctcggaacaacctaaagacggacaggtatgagtgtatggatgcgtaatcgactggggaaaaacgatccgtagtggtttatggtgcaatggcgtagcagtggacgcaccaggcgcatacgcacattcgcacaacctatgctagcgcactcgcaggttcgtatcatgttccctcccatgtaacgcatgtatatgttgctgcgaagcaggattgcaaagcacaaggacatatcttttgcagcaggatggcaattctctgtgctgtacattgttaaccacaagcagttggatgtcaagtgcatggactgagggtccccgtgaacgtttatggggcatacacagtacagaggacggccattttggtgcctacgaatagggacgattacaacctcgcacccgtggacgccttggtggaacaggacacgcgggactacgcaactgagcagcagattatgcgggaggggggcagatcagcattggaccacgtagtctatcttgacagcttacagcaaccagcaattgtcggtggacagggacattgccaccgctcgcaggcccgtctaggttgtcacagcagtcgggatttttggctactgtttgcttccctttttaggccatgaaaattgcgcgataggagaatatttttgcatgttgatcgctcacgtcctgccagcctgtccgccccaacagttcctgcgaaagtcgacggcgtgctctttttcaggtgattggactaaggatggtaagcgcagaggaaaagcgtttttttttggttttgatacagtagcgtcgcataggcctggccttatactttttttgccctgcttggcacggttcatcagatctcatctggcctccctcacccccctgagagacccctcactgggccaaagtcgacagatcaagaagagtttaatagtcggagtgtgtccatgtgctcatgggttcctggactttggcttataccaaaggggtggtcaacagagatcaccgcacgtccagacacggccaagaagccaagtgatgcaggacgcacaacatggcgagactcgcgagacgggcttggcacactgtcctgctgctgttcatgttactctcaggacatgaaacgacactacaaaatagctaaaaaccggtttttagggtggcgcaaacaggtttaccctggccctgaatttcattttttggctttgtcgccagctgaggaacaatctcgctgctgcagcggacatcgttccctttcctccggtgctgggtgagaaaacggctttctccagtctaaatgaaaaaaaaggaaaaagaaaccataacgtagaaggcttattcgttgtacaggaacattcaaagagtcaatcttgcttcgagcaaggttcatttattctatgcattgatttcgagcgacagccatatagcacgcaggccctctaacgacacaacaattgataggaggagtgaagaacggaccgaagaagggggcaaaggtatgtgcgacgacaggccacacctgtcatcggttggtgttgcgaagcttgaaagacaaagacaaggacaagcgacacgcgccaaggttcagggcgaccaacagtgcagggttggcttggccttcttggggtgcacgcccttttgttcttgctcttgcgtcccaagctcggccacggggcagcagcacgactggacgagggcagacgcaaacttgacgctggaccctctcctctgttgactgcaaaagcgtgctcgagattggcacacagtaccttgctattcggaatgttttcggagcaacactatgacaacgtacgaggcacggtcgagtgcaaatcctttactcacacccagatcaggatcagctttaattcaaccacacacagacagacatactgtagtgcagtctgccaggggagagaggtacatactgtacatgtgtagacgaggctgcgggggtccattgctccaatccagggttactgcgggaatcttgggcctcattagagccttacgagaaccagctcaggggtcgcccagttgagcactgacactgaacaccgaacactggccagacgcttaacaggtttttttttcttagcccgttcgtgggtgtataaataccctcggcgaaattgtatttttcgccctcctctctcttgccctttattttgttcgctccctcatccgcaccctttcgctcgatctcacttgctcctggtccataccctcgcacacacacagactctctctctctcagggtttgcttatccgttccttctcgatctacgttgacctcccaccacctctgcccgcagcacgactgtgcgcttttctaacttatacctgtagcgtttctacagctacccactggtgagttactgccagtcccttgtcgcctgtccgcggccactgaggaagtggaggaggatcctctgttgtggtgcagtcggtgacccaaaatccttaatgcatcatttccacatacacacacatatacacacatacacacacacaaacacatcgacggaggcatcgacgccgttgttcacacactacagcggcggcgttgaaggacgaacgcaggactcggagaggaagcgccatcagaccgccctttagtcgccattttttttttggcttcgtggctagtgttctttcgttctccctcccagctttatccttcggcgtcttcaactgactgtttccgcctcagctcttcccgctctcatttctattgatgcatctattatcgccccaccgactgtcagacctggtgaattgcatttatcgttcttggcgaggagagacacaacaggtttgccctgtaagagacgaatagctttctgagccttcccctcgtcctcacccctctcacactccaccccaccctcgccacctcgccccgactccctgactcgaagctctgtccctcactcgtgtgtggattgcttggctctcgctggtttctattctgctgcagctcttctttttttttttttttcttttttccctccgtttgccagatctggggtactgtgatggacacagataagaaaaaagtctgtagcccttctcggacgccgcgatcgttggcagaactggcttgtgtgcaactgtaatgtgtgttgtgttcgttttgcacggtgcaccgattcagcgtgtacatgtacagtactgtacacatggagtggagtggttctccctctgcctgcgggactgcaggactgcaaggcctctcctcctatcccgctttgcctgctacgcatctgcgctgcatcgcacacggcctgccacgggtccgttcattttatttgccttattagcacccccagcgcgagcctatttgccttgcgtcgctgcatggcattgtatttaaaccacagtccaccccccacgctctctcagctcgctctctctctctctctctctctccacactcacacctttacacacacatactcacttccattcacacacacacacacacacagcactccactacacccttgagcatcgttgcagcctttaatccgcattgtcgccctctctcttgccctgcttgatccgcgtagtgaccctgtcctgctgaacagcgtctcgcctccccactccctcccacatggccgaaggcaagatggagctcgacgagctcaacaccgacgccgccctggcgcccgccactgcccaggtcatcgccacctccaaccctgcggccccctctaccgccgtcgtcgtccctgctgaaaagaccgaagccggcagcgtcagcccctcctcggactcgaccgacatcgcctccgaaaagaccgccgaccccaaggccaagaaggccgagaaggccaaaaaggacaagaaggccaagaagggcaagaaaaaggctggcgacagcgacagcgagaacggcgaggatgctgaggacgaagagcccaaaaaggtcgtcagctacctggagctttaccgctttgccaccatgaaagaccgcatctacatcttgtaagcctgatcccctttgctcgaccaccggcttcactcgcgtccgtggatgcatcgtggcctgtactaacttgcatgtccgtttctgttgctttttttcgtcccctccccttagcgtcgctatcatctcgtccatgatttccggaatcggtcagcccatggtcgcgcttttgatgggcgatgtcatcactggactgactggcgacaaacctccagaggtcaaggcggaggaaactctcaaaaacgtcaagctgtttgccctcattgggctgggcatctttgttgcatcgtacctccagatgtgcttctggaccctcgccgccgaaaaccaggtcaagcgcattcgcgaagagtacctgcacgccatcttgagacaggacattggctggcacgacaccggcaagcagtcagagtccctcaccacccgcctgaactcggacacccagctgatctacgacggaatggccgacaaggtcggacttgcgctctccagtttcacgaccttcatcaccggttttgtcattggttttgtcaagggatggaagctcagtttggtgctgctgtgcgccgtgcccttgatcggtgtctgtgctgctatgctctcccgtttcactgtcaagagcgccaccaagggccaggactcgtactccaaggccggttctgtggctgagcaggccttttcctcgatccgaaccatcgtcgcttttggaggacagcagcgcgagactgacgcgtatgtcaagcagctggacgaagcctttgtcactggcaggaagagggccatcgccacaggattgggcattggcatgttcatgctcattttgttcagcacctatgccttggctttctggttcggtgctcacgaggtttacaaaaagaatatggagtccggacaggtgctcaacgtctttatgggcatgatcatcggtgcctttgctctcggaaacatcgggcccaatgcctctgcatttgccagcgctcagggtgctgcctacagcattttccagacgattgaccgcgttcccactatcgattcctccagccctgctggagccaagcccgagaacattcagggtcacattgtcgtgcgcgatgtcgatttccactacccttcgcgacctgatgtccctatcctgaagaagatgaatgtcgaggtcaagcctggtcagactgtggccctcgtgggccactctggtagtggcaagtcgaccattgtcggtttggtggagcgtttttacgaccctatctgtaagtcttgctattgtcaacgcagctagtcgaatggctcgaacaatggatgtcatgggcttatcattgacatgttctcttctttgttacttcttcagctggctctatcactctcgacggaattgaagtcaaggactggaacgttacctaccttcgtgacaccattggaatcgtttctcaggagccagtgttgttcaacgccacgatcaagcaaaacattgcctacggtatccgtaaggatcaagccgagcccacggacaaggagatcgaggaagcgtgccgtctctcgaacgcacacgatttcatctcgaaactccctgacaaatacaacaccatggttggcgagaagggagcgttgttgtctggaggtcagaagcagcgcatcgccattgctcgtgctttgatcaagaacccccgcattcttctgctcgatgaagccacctcggccttggacaccgaatcggaacgtgtcgttcaggctgctctggacaaggctgctactggtcgctcgaccatcgtcattgcacatcgcctttcgaccattatgaacgctgatgtgatttatgttatggataagggattggtcatggaatctggaacgcacgagtcgttgctcagccagggcggaatctatgccgactttgttgccaagcagcagctcaagaccggaggtgttgatgtcgaaaacgattacgccgaagtccaagacattgaaatcaaggatgcccctcacattgccatcgcagatgaagccgtgacccagcatggaaccgtgggcgatcgccgcaagagcttcctctccaccaaacttcgtcgcatgtcctctgctcgctcaatccccagatctgacaagtcgctgcaaaaggtggacgccaccatcaccattcccgagaccccggaggagaaggaggcccgagagaagaaggagagagcggctcgcatcaaggctcagaaagcccccatcatgcgtgtgttccgcactatgcgtccagagtggactttagtctttattggcgccatctgcagtggcggtgctggtgccatcttccccttgtttgcaaagtttttcggagccatcctcaacaccctcatgtccaaccccgatctcaaccctgactatctgaaggacaccaaccatggagcgctcatgttcctcgtgatcggaatcggagcttttgtctccaacggaggagctgtcggtgttttcgagtacatcggagagaccatgtcccgtcgcatgagaacgcgcagtttcacggtaaggatttttgaaaggggggggggggggtttgtttcttttcttgcagaaaagcaaagagttttgatttagttggcaaaggcaagatctgacaaaaatccatcctcgtacattgcgcgcgaaaataggccatcattactcaggaaatgggattctttgaccgtgaggagaacagcactggagccctttcgtcccgccttgccaccgatgcctaccagatgcacgaacttgtctcgcagatcatgaagctctcgttccagacggttgtcaccgttgccattggcctgggtcttgctttcggtcagagttggcggttgacccttgtcatcttggctttgatccctcttattggcgcttcccagtactttgccatgggtactctggccggattcagtaccaagaccaagaaagcctacgagcagtcgggccgcattgcgaacgaggccatcaccaacatccgcaccgttgtcgcactcgccaaggaatcggactttgaggcacgctacttcaaggtcactgagaagccccaccagtttgctttgcgccgcgcttacgttggatcgattggatacgccttgtcgcagggagtgatgttctggacatatgccgttggattttatgccggataccgctttgtgaccgcaggcttgatggagtggaacgatctgttcaccaccatgttctacgtgatctttatggctatgggtctcggtcaaatggccgcccaattgtaagtcggggtgctattgcttgtaggatccgtgcaatgtttctgcatccttgtgtcttgcaggccctgactcttttcttcttccctttcatcctataggccacgctatgtcaagggcaaggagtcggccattaacgtgtttgagcttttggacaagcagacgaccattgatgcgtacaaggatggcatttcccccgatcgtgtcgatggacacctcggactcgagaacgtcgagttccattaccccactcgtcctgaccaccagatcttcaagggcgtcaatgtcagtgtcaagccctcgcagacggttgcccttgtcggaccttcgggatgcggcaagtcgacgatcattgctctgttggagcgttggtacgatgtcttggacggcaaggcaacgatcgacaagtacgatgtccgcgatctgcagttgaacaacatccgcaagcacatggcgttggttggacaggagcccgtgttgtttgacatttcgattggcgagaacatccggtatggtattcctgatggccagcccgtggaccacgagcaggtggttgcggctgctagagcgtccaacatccatgactttgtcatgtctctgcccaatggctacgatacccgtgttggtgacaagggctctcagctgtcgggaggccagaagcagcgtattgcgattgctcgtgcgctgatccgagaccccaagatcctgctgctggatgaggccacgtctgcgctggactctgagtccgagaagctggtccaggaggccctggacaaggcccgagctggccgcacgacggtcgtgattgctcatcgcctgaggaccatccaggatgcggacttgatcctggtggtcaaggacggtgcgattgtggagtcgggtcgtcattacgagctgatctcgcagggcggcctctatgccgagctctgcaagaagcagaacctggaggtgacccattaagttaatgctatcccacacaatactacaaaataatacacataatacttttgattgcatcaacatgtctgtccactgcttggatgtatctgtatgcattttgcccttggttgcagtctttgccctgtagactctagcttgttggggtggggagtgagaatgggggagtgcagttctgcgacccattccagacgatatgagatgtacttgatctgactggctgacatgggcctcttccctgtctggccctggctgactgattttctccgatgatggtgtgagtcaatacggcgacggcggagtggggtgtgataaacgctaatttttctgtcttcgtttgtcgtctttgtttttcgtcctgttcctcttcctcttctttgtcttccttatctccctccttgcctgcgcactcacgctctcttctccttcctccacactcggtcgactctccatacccccttcctccgtcttgcacgccacccacacccgctacaccaccatgacccgtgtattaaaggctggaattctcggtgccaccggcacggtcggccagcgcttcatcctccttctctcgcaacaccctggcttctcgatccacgccctcggtgcctcaccccgctctgcgggaaagacctacgccaaggccacaaagtggaagatgtcccagtccatccctgccgacgtccgcgacaaggtcgtcaagacctgcgagcccgagggcgagttcagggagtgcgacgtggtcttttctggactggacgctgatgtcgctggagagattggtaaggagacattacagcacacagcaacagttgcagcagcagttcatggccgcccttggtgtttatgttttcccattttcaaagacaaaaagatccacaaggttcaaagggagaatgctgaccaagttcactcctcgtttctgtgtgttttgtcttcgactgttgtttcttgaaacatgttagaaatggcattcctcaaggcggatcttgcattgttttcgaatgctaaaaactaccgcacgcatgaggatgtgccgttgattgtgcccatggccaacccctctcactttgacctggtgtcgtatcagcgatccaagcatcagctctccaagggtttcctgatcaccaacgccaactgctcgacctcgggcatggtcgtgcccctgaaggcccttcaggatgcgtttggaccgttgagcaagatcgtggtcacgaccatgcaggcggtctcgggagccggctaccccggtgtgtcgtcgctcgatatcatggacaatgtggtgccttttattggaggcgaggagtccaagatggagtgggagacgctcaagattctgggaggcatgaaccaggacctgaatggatttgagctcttgaagtcgaccaaggtgtcggcgacgtgcaaccgtgtgccagtgattgatgggcatacggagtgtgtgtcgatcgagtttgagagacggcctgcgccttcggccgaggaggtgatccaggtcttggagagctacagaaccgaggctcaggagcttggctgccactctgcaccggagcaggcgatcattgtgagcagagatgacgacagaccccagcctcgtttggatcgggagaacggcaatggatacagtgtgacggtgggccgtgtcagggagtgcaacgtctttgacatcaagttcacgctgctggtccacaacacgatcctgggcgctgctggatcgggcgtactgctggccgagttggcccagaagaagggtcttattgtttagaaagacgaagcagaggagaagggactgatcttgcattaatatacagtaattgaaaaagaaagaaagaaagaaagactgacaggacagaaagaatgaagtgttgacagaccaacggtccgttgttgcattccatcctagtcgacaatacagctgagcagcagcagtcgactggtgtgcgctcctgtttgctccgcccaatgagatcagagaatctcacgctacagtgctcttttaacacttctttgtgtcccctcttctgtttccggctcttctttttctttttcgtttcttcccttcatccatccttcccgccctccccccgcatactctctcaagcccatatacccagcttccttggtcatctgcaagaaactattcctctctctctcacccattgcaaccccttcggcatcccgcccgtctctcactctcgcgccctctctcctccacccctcgctaccaccgccttcgatgacgatatggctccgatcatagctgctgctccgtcgaggcggcggtacacttatcgcggctatcgacgccatcccaggagcatcctgttctgcatcgtcatgatcaccctcatcctgaagctcgggttctttatccactcacatctgtccgttatatcaccgcccgaggatctcacacccaccacacccgtggaacgcctcaacataccaaagcttgcccatgatggagcgccactttcgagctggaaaactgcctggatcgttcatcaagagctggactctgaagtgaccgacgagctgaagcaggcatgcacgctcgatcttgtctacacatgggtaaacggatccgacccagatttggaggccatgcggcagcgatacaaaaacttgtcgcctgcgttcgcgaccatggccatggtcatgtcctcgggcaaaggaacaaggcggatgctcaagggccaagaccctaccttgaacagattcagagacatggatgagcttcggtactctttgcgatcggttgctcagtatgcggacgcagggctgttcaaaaggatttatatcttgacgaccgatgtggaagagcaacaggaggaccaggagcgatcgatcacgggcgagaggatcctgcatcagcaaacaccacgctggttggatctcgagaaggcccaaggggtgatcaagctggttcggcatcgtgagatgtatgaggatcttgctgcgttgccgtcgttcaacagtctgtcgatcgaaagccagatgcaccgcataccgggtcttgcggacattgtaagttcttcaaagctcatctcgttaacaatccaaggtttcgtccttttttgtggtttcggtgacacagatgttgtgtgtgtttgtgcttgtgccctatttaacaattactacttttcgccgcctccttccaatacaatctttctcgaccctcgttctgcagtttgtctatctcaacgacgacgttttctttggcaacccgatcaacagcgcgagcttatggacacctctgtatggctttgtgttccatctcgacaccctcacaacggtggatcccgcaccagcggggccggtcgaggacatttcagctgtgggggagtggccttctctcatatacacaaactcgatcctgtccaagcagtttggagctcgccatcgtgtctaccttgcccatatcccacatgtccttagcgtctcgctcgtgaacgagatccaggctctttggccacaggagttttccagcaccagtcagcatcgattcagaggcgaaggtcaggcacgcgagattcaagtgtcgtttttgctggcgcactatgtgatggagcggcttcgggagacacagctaaagtcgtattgggcttatcgacttgacaggaatcaggatggccgactggactgggatgaacggcagcagttgctggagatggttgaaacgtatcactcggccatggacaagaggcgggaagcgggtccgcaagctgttgtcaagaatggtacgacggggtttttgaagggctacgatgatcgactgttcagggctgggatatcgatcaatgtcacgacgtatgcgctctcgggacaggacgagtatccgttcatgctggcatctgggaacctgaaaaagccgtcaagggtccagaacaagaggccgtaccatgtgaagcgaggagagaggcagtgtgtattcgaggtggagttttgtcttggtgctgcgttctggaatcagactgtctcgtccgtggatgcatcgatgggcgcaggatcgatttttgagcggatggcctttacagaatttcactgcggcgactgcttgctccatattttgcggcatgcaggggaggccgcagggtcgagtgcgatgttgccactggatcggacgtccaaggcctttggggaggtcgctgcggatctgtacaagtataattatgtggttgggcagacggattttgcgttcttgcagctcaagaatgcgaggcaagccgagggcgcgttgaatgggctgatgcgtcggaaggaggtggtgtcgttcttttgcatcaatgatgatgtgccggataatgcactgatggtcaagaaggtcaagaatgtgttttcagcgtttttgaagaggcgcttcccggtgtcctcgccctgggagaagaagcctggcttggacgaggcggcggccagaaaggacggtgtacagtacaacaatgccgaatagaaccatgcacgagtcgcaccaccctacaggtgtcgtccgaaaaagaaaaaaaaaaagactcggacaaaaacgtgtttgggtgcgttcgtggatcggcccttttccaagcctggtcaaccgtgatgctgttgccattggtgcagcagacgcagagacaagtgagcaaaatttgcactgaaaaaacgaaactctactgcaaaagatgcgcagaacgaaaaaaaaaaaaatatccctcagggcgatatgacccttttgttgcgatgtccctggagggattgacatccttcacttccagttgagacactccattccatcttcatctctgttcttcattcctcacttctcgcttttgaaaatacaagtcagtgctccactacaagaagccagtgctttcgatccgatcacgacccacgcggctgcagggtcctaccgcaaaggctctaacgcaaactacgcttaaaaaaaaaaacttcgcagtcatggcagtcttgaccgggttagcacccgccagagtccagggccttccacaaccgaccgaccactttcctcggcgataccgcaaccacgctcctttggtcattcgtcagatcatcccgcagggtgtgctcgaccagtgggcttcagacccagagtatgttatccaagccctgaatcagagtgttcaagaacaacaacaacagcagcagcagcagaagcaggagcgaccaccacaggcagcgagcaaggacgacacactcagctgcggcgcaaagcaggagacggtattgccacacgcagtagccgatccagcggcggtgctcttgccttatctgaggtcgtcgcaggaggctccacctctgcccgtgatggtggcagaggataccaagaactttatggacgatccgcagttcacaaagaccatcaccatgaccgccagggagattgtcgcccgtgtgctcatccctcgacctgtcactgctacagagttgtcctcgggtgttgtgccgacggtggaggatggcacggacgtgatggctggcgaaatggatacagtcgtgccaagtcttcacatccaggatgatgcgccgacagtactaggagtgactccagtgatggcggcggcagtggcgaggggtcatggatggatgtgccccctgtgtgatcagcaagccaacgatccagcagcacacgaccgccgcaggttctattaccgaggagcggtcccctcgtcgctgtacaggtcccttcgactccctgatctgctctcgtcgctttcactgccgacggaaacgaccgcctttgccaaggcgccgaacaaggacctgatgcggatctggatctcgttggcgggggcgacgacgccgttgcattacgatcgatgccatgggattttgattcagctcgtgggacggaagcggttcgtggtgttttcgcatgaggatacgaatgcgctgtatccgtacgatgggatctcgggaccgggccatgccagcaaagtgcgtgggttggcgcattgcttcccgtttacgatcaaggctacgaccgctactactactactactgctgctgctgctgctgctgctgctgctgctggctctttacctggtgtggtgtcacaacaggcagatgcagcggcgcatctggagaggaacgaggctgagctgttgggtcgttggcccaaggttaggaacacgacgccgtgggtgattgatttggagccgggcgatgcgctttatacgccgccggggttctggcacgaggtgaccagtgtggatcactcgatcagtatcacggtgccctgggatatggatgccagcgagctggagcacgttcctcggcacatgttttgagcatggcgatttttttttcgcaaaacatataaacatatagaaaagaaggctatagatacccccccaattcatctttcagaatacatctactttccaggtgcttgagctcctggactttcatggagtgagaagagacggagcacgtgactgccaagccaccttgatccgcgattatatggcagcttcgcactggacttgaatccgcctcttccaaactttagcagtatgaaaatgtgatgattttcggcgtggagttcgcaagggaggcatccgttcgacccatcgaccatcgatcaggattaacaccatccatccaaagatctgccgggacaccagccattttctcaactaccttcaggatggctcttctcactgttacttgtctggaaagaaaaaagaatccatcaactcactactcggcatcgcactcggaatgaatcactctaatgagcaggtgtccatctgtgggcacagagaaatgaactatcagttttggaacgcacaaggatcttgatcaatcaaaccactccacctcaatcgagcgctaaggggaatctctgctggatcagtggacgatgaatcgaatcacacttgcgaacacctgtgactccaccacaaccaacttgccgactccaaacacaatgtgtccacatcaacaacaacaacaacaacaacaacaacaacaggatcacagcacaaagaagtcagagacagatctacactcgaaggacccccctacaactccacgactcggacttttaagcagagtgtcgctaacaacaatggactttctttttctcctttgtgtagaagatggctcagcgtctcacttaccgccgccgtttgtcgtacaacaccaagtccaacaggactcgcgtcgtcaagacccctggtggtcgcttgacttggctctatgagaagaagcccggtaccgcccccaagtgcggtgactgcggtgtcgctctccccggtgtaagtgcctcgacacaccttcatcactcacaggacgcaggaagaggaaggagagggaggattggagggttggagaggagaggtgggaattagtgcagagtacaacgcaccagtggagtccaccgaacggaccttgtgcgataagggacttttcattggtcggacctcgttgcgaggaatggggagatggttgcgtggattcgaatctttcgcagactggatgcctttttacttttttccgaagtcggctttctgctggaaacgcaaggcaattcttcacagctcccttggcgagcgacatcaatatgtataagagtcaatgactggacagagtgagagagaaggagaaagagagaggaattgtggggatcaggatatgtggaggggggagctgctacttcaagggcgtaacatggaaggactttgtggggaataggagatcaaaaggcattgaaacacccaacggtcgaccatcaacctcaggaatacactgccgtaacgcgttcttcaacgcgctgccgagaacctgttgactgatccttctggctttttttttttttttttttttttttttttttttaaccacttaggtccctgctctccgccccaccgagtacgctcgcatctcccgccgccagaagaccgtcaaccgtgcttacggtggttcccgctgcgccaactgcgtccgtgacagaatcgttcgtgctttcttgatcgaggagcagaagatcgtcaagaaggtcatcaaggctcaggccaagtccgccaagccctccaaggcctccaagtaaacttacggaagcagaaacgcaatacgccaggagaaaataaaaagtcttttgggtctgtcttttccatcgctgtctcgctctcttattatgacttgctttatgtgatgtgatgtgagagttttgaccatgatcacttagagttttcttggcgttgccttgaggaaggcatgcttcgaggagtaatcgatccactggtgggttgtatggcagtaccaggcgagaggaaaccaatagatcgaggcatgaatcaatggccttgcatgcgataagggaaaatgaagggggtttgcataaaacgtgacttgaagctttttttttgaaaagtttgccccctcattcccatccacattctgcaggtcttcactcgcattaccacacacgcaacacacactcacacgcacgcggacacacagcgaccttttgttatccaacatgacaaaggctgcgcgcaaaccaaggggcacccatccatcatcaacagccaccaaaaagacaatgcgcgagcgcttgaaagcacaggagccaccagcacaggagctcacagaggaggaggtgtttgtcaacgcgctggatgcctggaaccatgtctacctcaacagcttcctgaccatgaaagaccccatacggcagctccggatagagcaaaaagagctcgacgagcaatggaatcgtctcaaccgtaagtcgcacgggagcttcatcagcagtggattccctatgtcaagcgaatcggcacctgatctcttttattcatttttttttcttcattatcatccaaacgtttaggtggcaagggcacagcgttcggaagggatcacgactttgagtatcttgaaaaacaacatattttcgagtacggactggaggagcactttatggagcggtacaacttgtctgtgatggcgcactatctctttatgccggaactggatctgaagcttctggagaatggcctcgtgggctttgttcgactgtttcgcgagtccttggagaacgatgctgcttcctctaatgacaacgagggcagtttctggagaacttttatgcagttgatcatgctggtaagtaagaaaagacacgggaaaaatggcgatcagtcgttgtagtatcatcggcaggtagttttcgatcttacccggattgaaaatcctcattcaaaccactctctgttttataaacataggtcatggggctccgtaaacgtcaggacagtggctcggatctggatcccagggagatcatggagaatgcatggatagccgagggtgctaaatacaacgagagcatgccggactcgtcacggatatctcaggatgcaatggtaccatctctttgttgatgaacaatttggtcaagacggcaacattggtacaaatatctgatgccagactttgatttactatcatggcgacttagaacactatggtacaagttgcgacacaggcagccaaagatgacaatcggctttatggactgtaccagaatacgatgaaacagctcgtaaaacacctgcaaggccgcgtacagcagcttcagtttcctgctgacaaggaactcatcaacaacctggtagagaggcgcaccggaaagacggaaaaattgtacagtgcctatgcagcaagtgggtcagatcatgccttgctggaggacctggatgaaggatggtttgagggtactgagcccgccctcaagagggaagacatctcccagtcacccgaacggcgttcctcatccccgcttttcgacaacgtggactggatggtcaaagagtacgccacccaggactttggaagggcaccgggcgttgttgagaatgatggcgatcaggaggtcagcagtgatctacccgccgatatacaggaagcacacacacataatgaggaggtcgaaaccagtgccactcaacatcaaccttccgcaaagagaaacactggcaatgaaaaggataaaggcaagggcaagggcacgggcaaaggccagagcaagagcgaacccgatcagactgcagcaatccaggatatgccagcagcgtcagaccatgatcaccacgaggaaacatatcaccagcgcaacgttgcagcgggttcaggtcacgatcatcgttctgggccggatcaacagcaaaacagtggcagctcctcgggaccgcggcaatcactgaaacgtggtgcctcgtccgttgcggcaaccacagcggcaagaagtctggaggagcgtgtgaaccgggcgattggagtcgtagaggctacggatgagttggtattcgggggcgacagtgatgaagagtttgtaccacctgtaccaaagaagagacggcgtaatggtgcctctccaggagccgacggtggacagaaggaagttgccagaatcagtagacccactgtggagcccccacgacggcttcagacgtcccagtctccacttcccacggcccaacacaggccagcagagaccaaaactagaaagaagaatcggccttggtctactcaggaacaggaaaggctgctggagttggttccgaaattcaagcacagtgcgtcggacaagtctgcgaggaagagaactgtcaaatggtccaagctcaaggagtttgacaggacgcatggcgatgtattgcactaccgcgaccaagtcatgctcaaggacaagtaccgcgacttgaccgataatggccagcatcgccagcttgtcagcgaactcaacagggccaagatgaagagcacaccccagcatcagtttccacagactggaccacaactatgagaggcatggacatgtattagacccctaccattagcgataatgccaagtaattttttttttttcgtcttcacaatatctgtgtttgggagggagaccaaacggagtacagaagcggaatgaaccgtttattgtccagacctcatcgctcgtgatggttttttttgtgtttgttttggtttatgttcttgattgacgagaggaaatcaaagggaaagcaattttaagagaaaaaaaaagtgcagactagattttctatctttctttactcgtcgcagacctgggtctcgagacccttgaaggaggtgacgggaacgtacgagacgtaggtgtacaacttctccttggcctcctcatcgtcgttacgcttgcgggacaagcgaacgcggatgcggtgctggacggtcttgatacccttggaccagatctgcttgttcaagctggggtcgacacggacatcggaggtacccatggtcttctgggcgaaggccttgatagccttgatggcgtgaggggcacgcttcttgaaggatctgcaagacaagaacaagaacaagacaaaaaaaaaaacgtggttaagaaaacgggcgcttgaataatttcgaaattgttcctggaaaaaagttgtgatcctgagatctctaagagtcctgcaccatggcagtctggacgatgcggccatagtgtggacttttgctgctgcttctgatgctgaaagaccaatcatcccatgaagcgtgggcgaggaacacgtttgccatctgcttcaagaggtgtgctgcaaggtgataataccatgctcgggcgcaccgcttgtattccaaaacacaaacaagtgttccacagttcctgatctgatccaattctccatgagtcctgcacaaagtcctcttcaaatgaccgctgccagtaagagatatttacctgccgtggacgtgcttgtgcaagtgaatggtgtactcacgagcgacaacgtcgtggatggtagaacgcttggtacccttggattccttggccatttctaaagagttgaataggtgatcaaggaggcgtcgttttgatgagtgtcttgttctgctttgccttcctgatatggagtggggggtccgagcacttttgtgttgcagagctgtgcatcagcgttcctgaaggcggtaaagtataggggcgatgctcccgtttccggcgggtgcagagcttccgccagatagaatgctttgtcttttggcgagtgttatgtttccacgattggtagatatgttggctgctgtcggcttcaagctgactgggttgcgagcatgcttggtgattgatgagacattaggaatgcaagatcaaagggccgatggagttgatgcggatatcctttgccatgatgaaaatgctccagctgactaaaatgtcctcctgagagtgatctgcggtatcgatggatcgatggatcgaccgatggatgcccccgtcttatgtccatgtgcgacagatgggcactgctgcaacttcgcacctgtaaaattgctttgagtagagggggaaccactgaggcccagggtgcggcgaagctttatgatttgctgttacggggtagcaatttggtagccgcgtgcgtaaagaagtcctcctgctgcgaccaaggttggagccctcctttccctttcacactcaactccaagatggttagtcacgtgtgacgctcgctgcccttccaggaggatgcacatcgatcctgctatcacacaggacgtccatccatccatgcaccgaacagagagacactactaccggcacaggacaatcgctttctcggatatcacagaccatcgattatcagcaaaaagaaaagcatccttgtagcgctgctgatggatttgatgaattcaggcgcatgcacgatggatgtggagtgctgctggataggagtatggcagcaggctggattcagatccgaggcaggaatggagattcatcgattgtgtccagaggaaacaccagaggaaaccaacgtccatccgactttagtcgtcgacagccatcagcgttccatcaggaagacaaaaaagctgccgactagattctgcaatcatccagcaattgcagaactgcaactcttcaaagccgaatctcctctaacatccatcgtccttccgtctctcacctttttcacgtacttcaggataaagtcgccgttaagcacgccaaagtcaccaaggtcctcggccgtaccggctcccgcggtggtgtcacccaggtcaaggtcgagttgcaggaggatgcctccaaccccaactctatccgcaacgttatccgtaacgtcaagggacccgtccgtgagggtacgtttcgctccaaatcctttctcttggcgtccaaagagcgatctcagtggacagtgtgtactggacagagtcaggaacaaacactttaagcaggatcacggatcatggcgtctcttttccacctctatctctcttttccacctatatctctcaccagatccaaacgatcctcctgcgcttcccctccagaccccttccttcagttgcgggactttccaacactgcatgatctacaggcacaggaacgcacgaaggaaacatcacacagagaaagggaagaatcgtcataactaacatctcttatcatcttgtacaacttgtttaggcgatatcctctgcttgatggagtctgagcgtgaggcccgccgtctccgttaaagagtctgtgtttgttatcttgacagcaggaataaaaaaagcacctttatcaccagaatcgcaacgtttgaccatcgagtgcaaggggagtttattttcgcttcacagagcaagtagattgccatctctccagcgctataaacgggcgcgactatctgccatgctctttttccatggtggggtgggatatttcacgctctccgccgaagtacgagtcgactcagggtttcgtcttttatataccagtccttgtatgttctcagcaactctgagtcttgcagtggggacaatgcgggccgcaggacattgtcgaaacttgtcagaaaaaaaaacacttctgacagtggtgtaaagtctttgagagcttggaactgtcgatgaagtcgccacaccaaacgtgccgttagcttttgttcgtcgtcctcacacataaccagagacgggtttgtcacatcggtgatcaaaagtgagagatcatgcagatgggtgcaggcccaaggtacttcgacgaggtcgtctagcgcgactcaagtcgttggtcgcgcagctggatcagagggaacgcttagcctcaaaaagcgcagttctgggcaggagcgcagtatcatcgccacgtctaaactgggcacccgatcgacgttgggcatacgaagatcctgcattgtggttgcagaataagccaaaatggttgggatgactacgttcttgatatcgtggtgaatgttgatccacaaagtctcaagcttttgctgcatcagcgaaaagtaacgacattccgtcgcagggttcctcgttccacaattatgcatattcattttcagacttgagagttctgggcatgatgttgcgagggttctcatcaactcttcggcatagttctctgtgatgggtgggagcacaaggcggtccagatgaggacatgctttcaagaatggtatgagaaaagaggactcgtaaccacttgtttgggcgtaaaaggcaagctgacggattgccaagggctcccaagcgcgtggcggtatcatcaacatcttgggaaatctgatctcttgcatctcgtacccgcgtagggtaagcttccgtagcgatcgagggagactatgaagaaggtctaagaaaagcacagggtcgatggttgattcttctacgagttccagatgtagcctccacagacttgtcagatgaggcaaacttgacagcacgtggcgctgaacgtggccatagtggaactccaacctcaagtctttgagttttcgatttctccacaaaagtgcaagcgccgagtccgttcgtgaagcagatggtgaaggatagacgcgatagcagtccagtcgctcgagattgttgcagagggagtcgttgaggaatgtctcgagctgagggatccgaagatattttatccatcacgaattgtcgcgtaatagaccttgattctcggcggacttccaaggtgcgtcttccgtgttagggatgagctcgacggcacgccactcatgggcggcaaaggccgcattccatgctttacacactttcctagagactataatatcgcaggtactgagtgaactgcatatcgactccacaagaagtggaatgtcaaagatggagaccatgtgcttgttcatgctcgttcgtgtcatttcttgttttcgggtctattgtttgtggtcaaagtgcagtcaggcaacgagagcgaaagcgagagagagccggcgcgagggaggaagttgtatttcatttcacatcaccacgtatattgttgtgatatgatctctgatgcggtcggcattctggaagtgaacgcgcacatgcggtgatatctcacccgtaccatcaaagtccgagtcgacgaaactcgtcctgcgtcatttgaccgctcaaatgttgcagtccaaccttgagtggcatcgttttgaatccttgcccaagaaaaggtaccgggcagtggcgtgaaaatttcttgtcgtcggtcctgccgatgcaactgcagcctcaggtgtgcagtctactcccttcagtcatcatcattttcatttacttgaccataaaagtccctggcgtctgccgcgacgaaatcacgcatttatcaagtttttttcacggtacagctagctaagatggtccgtgcgctagcttaaatctaaacgtgctgtgatcacctttgcagatggaattgaatcccggcctttttcaagatgcacatggcatttcttgtcgattgattgatcccctcacctccagatttgtagaccgtccacaacagctgttttgtgtaggcaggatcctcatctacctgatccaccaggaaccgaagaatatctggttcctttgcaagatcgataatgcccattgtctgatcttcaaaaactggtgaggcgctcatctcacgcactaaccgttcaacagtcatgtcgccaagtgatgccggcgtgcccgatatcgtgaactcaaggactttcgaagaatgaacatcgttctcaacggtcgctgtttgcagttgtggaagcctgggtgctgctcggatcgttttcgagatttcatcttcttggtcccggaattcaagagctgccagttgcaaggacgaaatctctgcaaaatcatcttcccaattatcagcgtcaaccatgtcctcttccttcgtcacatttccatgcgcgacctccacatcagtctcatcctgaatttcatcgcattccatgtcacactccgcgaggacaatcaactccttggtgacgtgctcgagaacgacctctccagattccttgctagtctcaacggtctgggtagtgtcagtggtgtcggtttgttcgttatgctcgcgaacaataatggtttggatctcagtctcctcaacgacttcctcgacctcctcgatttcctcgaaggtctcataggtcttaacctcatacatccacttatcgctggtggtggtctcgcgttccttccactctacatcgaacttctccttgtaggtgacctggaaggcccccttggcggattcgatggtctcgtgagggccgtccaacttgtagtcggtctctccccagcggtagtagacgtagtacaccttggtctcgctgtcaaagataagctgggtcacataggtgatgccagtgctcttctcagtgaggacagagtcgtaaacctcgtcatcgtagtagacataggcggtcttggcgatggggcagacgtgatccaccttggccttgcgcgtggtgaggacctggacagtgcgcttccaaacgccatcgaccttgtggagagcaccagaggcaacatgtccagcaccgtaggcggcaccggcagtcactccaatggcgatagcaccggcaccaacgacgagagcgcctgctccatgagcagctgcctcagcgccagatagggcgcgacggaaccaggatgacttctcagagacagcaggcttggtgacctcaccggtctccttcttggtgacgacctccgtgacctcagtctcggtctcttcctcaatgacaacagtctcctcagtggtctcgtgttcgagagtgacaacctcctcggtaacggtggtggtggtctcctcggtgatcttggtcttgttgtcgacctcgatctccttctcgcgagcgatgatgagttcggcctgggtctcctcgataacttcctcgacctcctcgacctcctcgaaggtctcgtacgtcttgacttcgtacatccacttctcgctggtggtggtctcgcgttccttccactcaacatccaacttctccttgaacgggacctgcaaggtctccttggcgaagtcgatgggctcgtgaggtccatccaacttgtactctgtctctccccagcggaagtagacgtagtacaccttggtctcgctgtcaaagatgagctgggtgacataggtaatgccggtgctcttctcagtcaacacagagtcgtagacctcgtcatcgtagtagacataggatgtcttggcaatggggcagacgtgatcgacatgggccttgcgcgtggtaaggacctggacagtgcgcttccagacaccgtcggccttggtgagggctccagaggcggcctggccagctccagaggctgcaccggctgcaatggcaccggcaccagcgacggctgcagcaccggtagagatggcgcggcggaaccaagatgacttctcagagactgcaggcttggctaccactccggtctccttcttctccgtgacaatgacctccttgacggcttcatcgtgctcctcggtctcttccacgacaacggtctccttggtgacgtgctcgagggtgacctcttccttggtgacagtggtggtggtctcctcggtgatcttggtgtcgtcgacctcaatctccttctggcgagcaatgatcgtctcggcctcggtctcctcgatgacctcctcgatctcctcaacctcctcgaacgtctcgtacgtcttgacctcgtacacccacttctcgctggtggtggtctcgcgctccttccactcgacgtcgaacttctccttgtaggtgacctggaaggcctccttagcagactcgatggtctcgtgaggtccatccagcttgtagtcggtctctccccagcggtagtagacgtagtacaccttggtctcgctgtcaaagatgagctgggtgacataggtaatgccagtgctcttctcagtgaggacagagtcatagacctcatcatcgtagtagacataggcggtcttggcaatggggcagacgtgatcgaccttggccttgcgggtagtgaggacctggacagtgcgcttccagacgccatcgaccttgtggagagcgccagaggcaacatgtccagcaccgtaggcggcaccggcagtcactccaatggcgatagcaccagcaccaacgacaagagcacttgctccatgagcagcagcctcagcgccagagagggcgcggcggaaccacgacgacttctcagagacagcaggcttagtgacctcaccggtctccttcttggtgacgacctccgtgacctcagtctcggtctcttcctcgatgacaacagtctcctcggtggtctcgtgttcgagagtgacaacctcctcggtaacggtggtggtggtctcttcggtgatcttggtcttgttgtcgatctcgatctccttctcgcgagcgatgatgagttcggcctgggtctcctcgacaacttcctcgacctcctcaatctcctcgaaggtctcgtaggtcttgacctcgtacatccaacggtctacggaaaataatatgtatcgagttagaggcagttgcaatattcatcggcactttcagttcaacagtacggtagcacttaccactggtagcgatctcacgctccttccactcgacgtcgaacttctccttgtaggtgacctggaaggcctccttagcagactcgatggtctcgtgaggtccatccagcttgtagtcggtctctccccagcggtagtagacgtagtacaccttggtctcgctgtcaaagatgagctgggtgacataggtaatgccagtgctcttctcagtgaagacagagtcatagacctcgtcatcgtagtagacataggacgtcttggcaatggggcagacgtgatcgacatgggccttgcgcgtggtaaggacctggacagtgcgcttccagacaccgtcaaccttggtgagagctccagaggcggcctggccagctccagaggctgcaccggctgcaatggcaccggcaccagcgacggctgcagcaccggtagagatggcgcggcggaaccaagatgacttctcagagactgcaggcttggctaccactccggtctccttcttctccgtgacaatgacctccttgacggcttcatcgtgctcctcggtctcttccacgacaacggtctccttggtgacgtgctcgagggtgacctcttccttggtgacagtggtggtcatctcctcggtgatcttggtgttgtcgacctcaatctccttctggcgagcaatgatcgtctcggcctcggtctcctcgatgacctcctcaatctcctcaacctcctcgaaggtctcgtacgtcttgacctcgtacacccacttctcgctgctggtggtctcgcgctccttccactcgacgtcgaacttctccttgtaggtgacctggaaggcctccttagcagactcgatggtctcgtgaggtccatccagcttgtagtcggtctctccccagcggtagtagacgtagtacaccttggtctcgctgtcaaagataagctgggtgacataggtaatgccagtgctcttctcagtgaggacagagtcatagacctcatcatcgtagtagacataggcggtcttggcgatggggcagacgtgatcgaccttggccttgcgggtagtgaggacctggacagtgcgcttccagacaccatcgaccttgtggagagcgccagaggcaacatgtccagcaccgtaggcggcaccggcagtcactccaacggcaatagcaccggcaccaacaaccagagcacctgctccatgagctgcagcctcagcgccagagatggcgcgtcggaaccaggacgatttctcagagacggcaggcttggtgacctcaccggtctctttcttggtgacaatctccttgacaatctcggtctcctcctcgacgataatggtctcctccttggtctcgtgctggacagtggtgacctcctcggtgacagtggtctttgtctcctcgtggatcgtggtgccttcaacttcagttgccttctcgcgagcaatgataatctcggcctcactctcctcaatgacctccacgacctcctcaatctcctcgaaagtctcgtaagtcttgacttcatagacccacttctcgctagtggttgtctcgcgctccttccactcaacatcaaacttctccttgtaggtgacctggaaggcctccttggcggattcgatggtgtcgtggggtccatccagcttgtaatcggtctctccccagcggtagtagacgtagtacacgttggtctcgctgtcaaagatgagctgggtcacataagtgatgccagtgctcttctcggtcaggacagagtcatacacgtcctcgtcgtagtagacataggcggtcttggcgatggggcagacatggtcaaccttggccttgcgggtagtgaggacctggacggtgcgcttccaaactccatccaccttgttcaaggcgacggctccagcgacggcggcggcaccagcagcgacggcaccaacagcagcactggatcccaggacacggcggaaccaagatgccctctcggggacagcgggtttggtgacagtgctggtagtcttggtgacaatgacctccttaatctcatcgtccttcttggacagctcagcagtcgtcttttccttgtcaacaatggtctccatggaaacgtgctcaacggaaactgcaccatcaacggtggtggttgtggtggtggtatccttggaacgcgtggtggtgtcatccttggtgacatcccgctcacgagcgatgatgacctgagcctcagtctcgtcgacgacctcctcgatctcctcgatctcctcgtaggtctcgtaggtcttgacctcgtacatccacttctcgctggtggtggtctcgcgctccttccactcaacatcgaacttctccttgtaggtgacctggaaggcctccttagcagactcaatggtatcgtggggtccatccagcttgtagtcggtctctctccagcggtagtagacgtagtacaccttggtctcgctgtcaaagatgagctgagtgacatacgtgatgccagtgctcttctcggtcaggacagagtcatagacatcctcatcgtagtagacgaaagcgtgctttgagatggggcagacatgatccacaggagccttgcgagtgttgaagacttggacagtgcgcttccaaatgccatcgaccttggtaagggcaccaacggcggctccgccagcaccataggcaatgcggcggaaccaggaggtctccttgctgacggcaggctgagcaacgactccggtctccctcttgacaacgacttccgtggcaggtctgtgctcctcctcgatgacaacagtctcctcggtggtttcgtgctcaacagtgacctcctcctgagtgacagtggtcgtggtgtgctcgtgaacctttgagccatcgacaacggtctccttctcgcgagcgataatgaccttggcctctgattcatcatagacctcctcgatctcctcgatggtctcgatctcctcgtaagtcttgaactcgtagacccacttctcgcttgtagagatctcacgctccttccactcgacatcgaacttctccttgtaggtgacctggaatgcctccttggcggactcgatggtctcgtgaggtccgtccaacgtgtagttggtctctccccagcggtagtagacgtagtatacgttagtctcactgttgtaaatgagctgagtgacataggtgatgccagtgctcttctcagtgaggacagagtcgtacacctcgtcgtcgtagtagacataggaggtcttggcgatagggcacagagcatccacatgagccttgcgcgtggtcaggacctgagagatgcgcttccagacaccatcgacattgacgagtgcaccagcagttgcagcaagtccagcgccaagagcaaagcgacggaaccaagatgtctccttggtgacagcaggctggttgacgaccaacaccttgtcagtggtggtcgtggtggtcgtggtctcatccgcagcttggtcatggacggtagtgcgctgttgctcgcgggtgacgaacctgtcgtgagtctcgtcttcctcctcactgacatagtccacaaactcctcctcagtgccaaattcgtggtggacgatggaccattgggctaatggaagtgaaagtggagaatcaatgttaatattgccctttggtttgagtatgcaccattggcgcctcgaagcagcgacactacttactgttggtgacagttcttctctcctcccagctgacaccgtaggcctcagtgtacttggtcttgaaggtgactttggcctcctcgacggtttggtagggtccatccaagacgatctggtcctcaccccagcggaggtacacatagtatgtgtgctccacatagttgaagagcaactgggtagtatagatttcaccagttgtcttgcggctgagcgagacgtggtagatctctgcttcgtcatccgagtacacagtcgcctgatcagcaatggggcactcccgatcgacgaactttgcggcagagactgaagttgtggaagcagatcgcctggggacagcgacgcctgatcgctcggactcgatagtgatagtgtcgtattcgaactcgacagcagaccagttctcgccagaggtgaccgcggtctctcgctcagtccactcgatgttgaccttggaagcgaagatttcctggaactcgcgtgtggcctgctcagtggtctcgtaaggtccttcgagttgtccctcggtggaaccccacttgacgtagatgtagtagacgttcgtggtgttgtcgagcagcaattgcatcacgtagtcaactccggtaccagcctccttcaagtggcaagcccagacagttccctccctctcgagaactgtggcattctccagaggacacatggtgtgaacgcggacaatgcgacgggtgcgggtgatggtggtagtggtggtgatgaccgtatacttggtgaggtaggtgatataacgcttgtagacagtcttgtactcggtgatctcgcggtcgatttctaggaggcgcagcagtgaagatcatggtttagtctcatatctctttcgacgaagccggtgcaactttccgcgaacattttatcacttacgcgtgacatcgtagctcgtgctggtctccgaagtggtgagccagttgaacttgacggcatcgtagagccctacaaaggatatcaagcatgtaatgagtcaaactgctctggcaaacctgcattgtaatgatgcgcgggtgaatacttacagatggtcttgctggaggaacgctcaaccaacatggccttgtcgttaacaaagtcaacaacgcggctagagtcggagatcaaggagaatgagccatcctcagagaactgccactgctggcaggaggcatcggcctgcttggaggtcatgatcaaagcaccggtgctgtcgaccgtcaggtacaaaccagtgaagcggttgataacatacgaaccctccagcctccaaagctggagctcgaccagggagtggcgctcagcagaagagaatctcttctggaccaccagatggatgtgggcaccatcggcaccacgctcaaggatatgagaggcggtgatcgaggcgactttgttaccggcaaccaggtagaaccaagactccttgggtgcaaccaagtgctgcacggtctcggcgtactcgatgacctcgttggctgattgtatcattcaaaaaaaggggatattcatcagaagagagatccatcattgaccctgcaatgtcagcactacggttgaaatactcacaggcggcggaagaacgcaaaacgacctcctcgaattcctcgtagaactcaaagtcctcagacaactcctcctcaatgagagtgacctcggtccagacgagccacgaaagggtaacctcgtagacggaccctattatcgaatcaataacaagtagtggtcagtactgcgcataacaagggctagctgtccagtgcgacaaagcaagcaagaaacgagaactcacaggtgacagcggtggtgcgctcaacaacaacgacgtatccatcgcgaacgttgagggcaaggtgagagtgctgctcggggaggataaatcctgactcaatggcccacttgatagcgtccttgggcagaacctggatcagacgtgcaccctccttggcatcaccctcaagggtcaaggcgagaccagtgcgcttgttaatcagatatccatccttgagagtccaaagctggatatccaacatggcatgctggttggcagaggcagcggtggtctgagggtggatggaggcgtacgcgcccaccttcatatgatttttgttgaaaccgtgatcaatatcaacaacctgaccgtcggacgtgcggatgaagaagtaggcggagcgcgagaatttctccaggctgcgagtgacaacctgttccttcttgaggtaagagatctcgttctcgctcgatgcatccgacttctcctcctcggccaatgtctcggtgacggtgtagtccaaggtcaaccaagagaagtgaacctcagcgcaagaccctacagttagaaaacaaacagaaagtgtattagcaaaagaaatgcaagtgtgcacaactgcatggttttaacaaagagtaatggtaacttacagctctgaacatgctctccttggcgaacgtgtctgatgtatgcacgggagccctggcgtccgtacgagaagaagatggcaaagtctctgcgggaggcgagacgaataacaccttcctcaatcacccagcgctgagtatcagcgccagtcttggtggtctggatgagctgagcattggcctcgactgatatatggcaaaaaaaaaagtgcgggtgagcaggagatcggccaatttgtctatgcatcagttacatgcgcgagacgagtcttactctgatcgacaccaagcaccagtccggagcgacggttaatgatgtaaccgttgtcaaatctccagagttggagctcaaggagagcatgggagtgctttccagacttgagtctctgatgggccaggtgaaggtgagtgccgggctgcaagtggttgatctggcggccgtgctcgacctcgaggacgagatcgctgatgcctgacttcaagtagaaccagcagttgacaggagcgtggcggtgctcgacaacgcgtgccaagttgttggcctcgaactccttgagcaactcgacatcatcctcgacggagtagctgcgctggatggtcagccaagtgaactgaacagcctcgaaggtccctgcaaaatgaaaattaaaaattgatgaatattggaaagtgatacacaccactatcactttgtctccttcagtaatacttacagcgctggtccaggttcttcttgtccttgcgctcattgagggcaatgcgcgcaccatcgcgggtaccatcaccatcgacgtccaagaccaagttgggctggctcttcaagtgaatgaaaccattagacacagcccaaagctggttctcgttgctctcggatttctggctccactgaatgattctggagcctgccttcaaagatccctggtagacatccagaaccaaaccggtacgacggttgatgatgtaaccatccttgtagcaccacagctgcaactccagcagcgcatgtctcttggcagaggcatagagcttttggttgttgagctcgacatacgaaccaggcttggtgtgatcgcgcaagaaaccgtgctcaacatcgagaacaaggcctgaggctctggacttgatgtagaagtacttttctgaggggaactcggtgtggatggagatctgtgcctcctcaagaccctcatcgtaagaagacgagcgaatggccatgcgggaatgtttcagccatgctgcggaggcgagctccaaagtccctggatgagttttttttttttttgacgatgtcgtagaaaggaaaatagcaattagaatcacgatgcagtcgcggcagcgcaaagccgactagtttgtgtgctgcttacaggtcttaacgccagactgcgtggacttcagctcgaccaactggacgcgagagttgtccttgttcgactcccccccgatgaccaacttggggttgtacaccagctggatgttaccctcgacaacgttccagagctggttgtgctttccatcctcctgtggttgcacgcatcataaatcagttagcaatgcctttccatactatgttggctattcaaatagtactttgaaatgcgattattttctccttttcttacctcaatcgtcgccttgtgctgctggatcagcttgacaccaacgaccgctgaacgaccataaatgtcaatgacatagttggttctacggttgatgaagtaaccatcctcatatctccacaactgcctctccaaaagactcttatcgggatcgtcaagcgaacgctgcttcttcatcgagatgtaagcaccagggtcggtgggagaggtgatccagccggcctccaggtccatcacaaagccagttgcgccggacttaatgaagaaccagtcgtcgttcttgatggtaacaaccttcgagatgtgttctaaggtacacagaatgatgcgaatgggtaagactgactgtggcattgttgcgacaaggccatgtcactctctaacttccactgacttaccggtaacggttctagtgatgatgcggtcatgctggaggaactcaaaagatgcgagctggaagacccctgaagacgagaaagtagcacacagttgccatacgggttagaacgcaaggagaggcggcgcgcaattgggtcagcggtcattagtgggatcttacacttacactgctggtccgagttgttttcggccttgggcctctggagcgatagacgggcgttcagcttgctaccgtcgccctcaatgtcgatggcaaacagaggcttgccctgtataataaggttgccgtccttcgtttcccaacgctgatgatgggcctcctaaaaaaaatggacaaggtgaggcggcacgcgaaaatggtgtgagcattgaagcgttttttgatcaattcaaccattcttgagagcacaggaaaaaaaggtttttttgttttacctttccttgctttggaaccccctgcatgaggcgggcgccatagcggacaacaccttgcttgcagtcgagaacaaggcccgatctcctgttgatcaactgaccctcactgtaacgccacagctggctctcgagtttgtcacgctgctcctcagcatcggtcatgacttgagcgttcatgttgacgaggacgttgggagccatagagtccgtcaaaaggccttgctcgacatcaatcacataaccagaagaccgggacttgatgtagaaccagccggcggtaggcagaacagtggtcgtggggaaggtagtagtgctggtggtcgtggtagtggtggtaactgaaacagggactatgagagacaccatggtaatattagcaaccaaagccagcgtgattgtatattcgatttgctgaccgatcggctgctaaaagggggacttacgttcgcgcgaggcggtctcctcgacgacggatgttgatggggtttcgagccaggtgaacctagcctcctccaagagccctatgtaaaagagaaaatccgataggttcgttttctaatattagaccaaaagccctcgcaaccacatttttctcgcctacgaatcacatttgctcagaccccaggcctgaaagcagaactccttgctaaaaggcgacttgtggacacttacacttttgatcgttattgactgcagccttgcgctcgccaatggcaatttttgcgccatccctggatccatcgccgtcaatgtccatcacgagtctagagttgtaaacgttggcgatgaagccgttctcgtagaaccagtgctggttgcgggcgtctttaccagacttgcgctgccactgaacgactctcgcagtcgctttgagcacgcctaagtattatgcaagaggggatacaagtcagtgtcttgtaccttctttcatgtttgccacatgaaaaactgattgcttggtcaaagaaaaggcctgaggtacgtaccgccctggatgtccagaacaaagccggtgcggcgattgatcaggaaaccggcctcataacgccagagctggagctccaacagggaatggcggccgtcgccgttatcgatcttctggtggttcatttcggcacgagcaccggccttcatggggtcggtgaagtaaccgtgctcgatatcgaccacaaggttagaggcagccgacttgatgtagaaccagcttgtggggaagttatcgggccggatggagatggactctgctcttgagggagagggggagaccgggttgctgcctccaccaccgaggtagttccctgtgaagtgaatcagatcaagccatgctttcgtcagcttcggaacacacttgagagcagctcatctctctttttttctctgatcgtgtttttcaacacgttttttttttctgtttcttggtgagattcatgaacccttacatttttgcttctcgttgtaggccttcttttcttggatcaagatacgggttccgtcgcgggtgccgtctccatcaatggtgatggcgaatttagggttactggccacggtaatgacaccgtcgtcggtaagccattgctggccagcagcgtcctatacaacccaatccaatggttgaggacaagattgagagcggtatcagcgttttgatacattcattcttttttcagttcattggcatctgtgggatttcccgtctcgtttcaaaaaccaaccactcccatttaccttgccagtcttgcggacattttgaataacacgcgtacccggacggacgacgcctggttttagaaatagacagcgttcgggttagcatcccatgctcaggcaaagaaaaaaagtagagcattatttcgaaacacccccttggacgcgacaaaaaaaaactgattcatgcatctcgttccttctgttgacctccccccccccccccccatgccatagccatggtatgcgctatgcaatggtattgctatgccaactttactctctactcacttcgtcttcccctccccccttttttttctctctacgacactctgcatggcactgagggcagctgttagcaattcctcccacgaccgttatgctactctcgtcaccaaaaacgcacatgctttcgattctcgaaagaaagaaaaacatggcctttgccaaccacttccccttgataaataagattgaggataaaaaaacgatctgtgcccaatggggggaacttgcctccttggacatccaagacatggccagtacggacattgacaatgtagccctcctctgccctccagagctgctgctccaattgaggaagggaatctatgctgctcttgctagacttgcggtgagcaagttcgacacgagcgccggccttcagggggtccttcaggaacccgctctcgatatcgagcacgagacctgcaatgcccgactggatgtaaaagtgccccgtggggaaggacaagatcctgctggatcggccaggggatgagggaggagaacctgccatggctagttttttttttgtgttttttgcgtgtgctttttttgagggtttgtgagagggagaccggagggggtttcttttttgtgctatgtaaaaaaaagaggttttttttttttcttgtttcctggacctgttttttttatatacaataaatacaaaggaacgatgggttttccttaggggttcttgttcgttagtaagaggttagtaaacgttttcttgtttttgatgaggaagaagactttcgcttcttttttttttggtgtcaagcgcctttgtacagcgtgaaattgggcggcgaagagtgtgaaaagttgagtgtgaagtcgccgagaactgtgcagtgctcgtctcggttgtgaggaagacggtgaatggagggggggaagggcgtggggttgattcttcttgaattcaggcacaatgtcaagacaaggtggagatgaacaaggagaaagaaagagagaaaagagcaaaaagggccgggatgactgagttgatagggaaaatggcgatgggaacgagagggcgacggtaagtgtgcgagcgggcgatgggagcagcgagaagagcataagcggccatggtctggatgtgtgcgaatcccttggtcaacgtattcaattgcaggcgagtattcagtattcgcttctgtgcgttttgcacctctccctccccctccctccagtcactaagaggaaaagagccaatagagccaatagagtaagaacgcaagttgaatggtgttgaatggtcgagtccatcgtgcgaccctcagtaagtgcaagaggaagaacacgaaaagtacgcgtggatttcgggcgggttgcgacattggtctccctcaggctggaagctgaagcacactcctgcgtgtggtaagcagaaaaccataaaaaaaaataaactcgagctgagatcgaaaagaaaacatcccagtggatgggcaaaatggggcatggtcgcacaaccatagcgctgaatgctaggctgctagcgacaacaggcccatcctagcatctcatggggacactttttccttccttcctacctcttcctacctatcctcgttgacacccccttcctccctcgctcatccccttcgtgcaagtgcattggtaatgtgctttgcacatggaacattatggaaaaagataggccaggcgtcaatggtcaaggcgagcatccatccactgagggcaactgtatgctatatgtttaccctttcaaatcaactacatctacctttcaatcacttcaagtccaaccaacacatcaccaggttggggacatgtagagagaccctcccctccccttgtagacaatagtgctgcccttctcataatcatgagctgggaaaacgagcctatttctttcttcctgtcttttgagagctctaatctttttttattttttgcagcaagcgagcgctgcatggtgtgttcagactatgtaggtctgacacggaaacaacggaatgctcgacctggcccatgagaccaaccggggaggattcttttgtcgagcaacgtggtacggagcacaggtgtgctatgcccagaaacatccgtgttgcactcgacagtgtacttgaatgaaccaggttgtggtcatggggtaccaatagccggtctcagcggccacccaaaaaaaaatgaaaaaagaccaactctcttttttgggcaggagggcgatcgtggaggcgtgacgaacggggcagggaccatggcgtaattccacgctcagaagacgggtaagattgttatgggatgacagacaaggtagatagactactggatgtctaaagcaatcagataatcgatttcttacaatgcaagcccttttttttatttttttgctccattccctccatttatgcactcatgtctctccttctatgtattgttaatatatgcggttccggagagcgtgctcttcgccatcgcatgtctctcgagcacacgcgcgggaagggcagatcgggcaatgttcatcctatggctggtaaaaaaggtggaaggagatcatcaggacacgcggggtagctcctagagagtaccgtgtgcgagcatccatggttctgtaacggaccatcgatcggtgggccgttggtcggggtaatagcgatgagattgagcgcccggcctagtggccatctctaagggactgaaatagatgcatccgctatgaggaaatgactttattatgagatacttcctcggcacgctcccttcttcccactcgcgcccatactacaagatggcggtagctcatggctgtcccgacgagcgagggttgtaaggtccgggctgtcctacgtggagggaagcagccatgtttgtagaagccgaagcttcccctccaccagaaccgcgtcctgcactagcagaatccttcacagcaccccgccccctgcagcatgtccggctgtgtcagttccatgttcttgatacgtgtgatgatgtctccatattatgctgctgagttttctgagcgggctagaggtaagaagaagagtgaaatcagcaggcgataggagaaggaagggaaaagtaagttgacataacctgcatgtctcgatttgacgcctcatgacccctcccttccgctcaaagagggcggaccctacacgtaccaagagatctctatcgtgcatgttacgacgcgattcttctcgctttgttgacaatcgcatagggcaaaaaggcagcaatgctaaacaaccaacaagacgctcttgcttgaacacttggtcctcttcctctctctctccccttacagaagaagggggtgcttctcggcatcaaaactgggtggatggatggagtggattcttacttttcccttgcaccgcttgtaatgcccgatgatggtcgctctgcatgcgcgctttccccaaactcgtgtctgatgatcgagacggtcgtaaacacttccacccgcgcttctctagcatgggcttttttttgcgatttgtttgttgctgacagcgttttcttgcatacagcattgttgattttagagagttggtatgcaaatggcacagacacactcatgcgtctcatgctagtgatagacatatcaacaatgcagaccagcagtttttttattcctttcatgctgctttgaactatagatgttgggggatgtaagagcctctgcagactgcaagatgagatgatgtgcctcgtgaattagcttgttacgcccccccctccctccctctccttcgcgcgcgcgcgcatttatggccaactttaacgaacgcacacgcaacaatgcaaaagagtgtatacccgaccatgcgcgcctttgttgattgatccttgggcactacaacagaacattgtggaaattgatcctcattcctcttcgtttctgctttagctcaatgtgttgatctgctacatatgcgacttgggggcaagggttcgtcaaacctcttttgatcggattacgcgacttgttggaaaggtttcgaaaaaaaagtgaaccgacagtagacgtgcaatgcagtgaaagtatcggacatttgttggtggttacaactttccttcagcaaagcagtcagtctgtgttacagcaaccagggtcaagagaccaacccgtccatgtcctcctcccttgttccgttcaagacgacacaaaaaaaaagattggtagtgcagggcttgtaaaattgcattttggtcatgtctctgtcctcaagccctcttctgtttcgtttcgacagtgttcgtgaaactcccagcgctatttcggtgttgatcgacggcgacgatgccttcccagtgaggagaatcaggagatggtgctggcgatggatgtgttgctgcaatccgcatagtgtattgacttcaaagcgcagtcgagccattgcataagcgaatgatgggataaaaaaaaatctgagcaatggcgtccttgtgcatagcaaatcatccagcttgtcccaaccctcggtggaaatccgatgggcgatgcgccaaaaaaaatcgagagccaggccgagtcactgtgcatgaccagcaaagactaacctattctcacagacaatccctgaatgaatggtccctcactcttcccttctcggtctcgagccattgagaaaagcggcgtgcaagttgtcttgacactggcagctccgtatccccgcctctcgcatggagcacactctccgcttgaaacgtgcacctgaacagtggtacatgtatttataccgatggagcaacccttgacgagggtgccttgattttgttagcggaggaggtagtttggtttttttttcccctcgctgaaccttgaaccagattcgggacagcggtacaaaacagtaaggatagagtgagtagtttactttatgcgtagaaaactggcttctgtagatgtgcttgtcacaatttttttgttgcttgagagcaccatctagaaaaaaaagaaaccataaaaaacataccatggccaactctatagactatcccatagcacgctcttagactgaatagcctcttgatacaattcaaacgacaacagcaacccccattttatccagcctttgagggcgaaaagaaaaaaagaaacaatacgccttgttcaaaatacagaggtcgtatgctcatttttcacacacagcgccgttttttatttttttgcgttgcgttcttcccagctggattacgagagagagatagagaaacaacaccgatcgatcctccggcctctcttcccccttcgagccgcccagcgtctcacgtttatttcattttcagttggcaacaggtggagcttcctcggaaagaacagagaggaaacgatcttttcggcgatcatccacagacgcttctttccagtcgcttagcaaaacaacagctgaagaaggacgcgttcgcgttttttgtacctggaggaggggtggggcgtggggggttaggcaagcaagcatcgggcgatgttgcgaatcgtgttaagcgggcggccttcattcttgaggtgggcggtacctccctctggtctccctgtcagacgcaaaaaaaaaggaaagtgttacaaagtcgtgaccacatgctaatggtccaggatcacagagagaaacgaaacaggtgcggtaccaccaccaccaccaagttcacacatgctagctgatcctctttcatagttcggtctgggcaaaaagaaaaaaccacattgaagcgggcatgcaggaacggaaacaccattgtgaacccgaaaggaaaggaatgcaatcaaaacggaactgaccccctttggcgctctctctcctccgctgtttcattctctctcacatacacacacacacacacatacacacagacgccttcagtatgaacaacagcaacccatcgctttttttttgactcgaaaagtcccggacagcaacccatcctgtagtccttttcgaagaagcgatcattatctctgaagcacaggcgcagagagcctccatgggaacatacaactgacataaaagacctgcacgcttgcacgcaagtcatgcatagaccagacccgtctgcagcttgtttttctttttaccgccattgctcacaacgacaccccttgcctcgcatagtttcgagcatgagccatgtctgtacagtactgtacagatactgtcctttcgagagctgggagtttttttctcttttgctgggcccgagaacttgcatcgggcgctcagatgctgcattctctcccacccctacctttcccgttcaattaaacacacaccaaatatattgcttcatatacaccgcatacgcactcttagccccctcccgatactcggcggatgaacggctgcatggcattagaccaaaacagttcttttcatttgtgcatggacctacagccatgtttttatatattgttggtgtacgtgtagtggaatacgcctgcgaaatgcttttaagacgagaacaaacaaacggagaagggggagggtgggggtatgtctacatatcaaccggccatggtgaagctaagatcaccattccccggcgaactaggcgcgtaatagaaccctgccatcagcacacagtagctgaggatcagaatgcttcccttgaagtaattgctcttgccctcaatataggtgtaggtcaacaagaagactgagaacaacatcgcaaagacgtcccatcgcgggaaaatgagattgaaggtgaacttccacatctgcaccttgccatagttgagccacgcagagaccgccaccatggcagggatctggatgagacagacctggagcgcatacgccgatccaatctccatcgacaacgcaatgttcccgtacatggcaaaggagatggcgttcatgaactcggtcacgttagggaccagagcgaataaggtcaatcccagcaacttttcatcaatggacgagaccgcatcgacgctgtcgaccaaaatttctgtttttttggcgaaagtgcgggaaagcgcgagagcgaggcagttagtttccgagctttgggcaggtattgcctctgctatgctgtcaataaagtaaaagagaagaccgaaggaaagatggatcttacctgcaatgatggaatacagaacagtgcagccaagaagaacggtagcactctttgctttagaccaattgggcgaatcgtgtcctccatgcgcctcgtcctcctcctcttcgtgctcatgcttcagcgagttgtgatccatagtcagagaggacagtaatccttgtgcagctggatgcaacgtcggaccatcacccgactctgcgccaattggcggtgtccgccgctcttctacaccaacgcgagtagacattgtctgataaccgggcgcaaggtggtgtcccatctctgtgtctcctgcggtgggtattgggcgatgcggcgcagcagcatgcgttccagatccgtaatgaagcaactgctgaacgatatgtgttgggagaagtttcctgtaaatggaagaatccctgatagtgggcggctggggttcgtgccagatttgcttcacatgggttctgagtgaaaaccagattccgatcaagtatgccgatggtagaatgatgcagcaaaagtacatcagcggcttgacattcttctgaaagaatacgtcgtcagcggggttgggctggtggtggtagcatcgttgacaggtcgcttccataggcagcggctgaggttctgggcagggcgtgcagcgcagttcaaactaagagtgtccggtgggcggggttagttaggaaaccgggtcttttaacagtaagagggtgccacagcatcaacatgcactctataacttacgcgcccatagattgaataaaacagcgtgggtgtcaaaactccaatgagagacatgataagcattgtagcagtgactcctacggaagcaaaagaatggaatggtatcacgttagtaaacgagatgcacatactcctggcgtactacccaatgtcgatctactcgttcctgcacttgcctgcgctcttggcattaaatctctgctccttcttcttgacggctccgctcatcatactcatccctggcatcaacagtagacctgccaaaaaactcccgatgagtgccccctctgtgatcaggcccttgccctgcgtcagcgccactgaatacaagataatctcgatgatggatccaaatgtggcgttgataactgcacccatgcccaaagacgattgtgccgagatggatgagacagccatgccaataaagtatgacagcgggataacggaggccagacccagcgaaaagatgacctctggcgaggtgaggaccgagtcgtggcccaagacgtgggtgagcacatattcgtccaggattgtaaagaagacgacgggcagcaggttgataaagatgatgttggtgccgtcataggtatatttgtagtactggaatccgatgctttcgtatgtgcagaggagaatctccgatctctgaggcgaaagagtcagggagcttccgcgtttaaagttgagtcgcagcgggtcctgatgcaagtgcgttgccaagacataagtcagtttgcccattgggatcgagatcaccatgaaccagcacaggcaggagaccagcatatgcagagggcctattcagaacgagacagagtggggttggctcaattccgttcatcttgtttttgttcatcccaaactgcagttacaaacccaggaagcaggataaggggggcaggatatagagaaagtttgcttacctatcagggtgtagtaaaggagatagtaaactaggccacccaggcccagacggaagatatggctgggtagattcctgagttttgtgatgaaacgcttgtgctttggcgtctttcgttccctctccagcagggagctgctcctggagagtagtggttgtgactcatcgccgccatgtccattggtggtgatgtccgatcctatagggacatgcagtctatctgtcctgagttcgcccggcgacagctccctctcgacatactggccaaagggccagagcaggtagtggctcagtccaaggacgacgcggccgtacgggcgtcccccgaacggcgtcagatagagcacgatggcgacgaggaggcagaccaaggccagccaccagccaaagacgagtgtccagagcacattgccgacggagaggtagaggtcggaggaaggctgggagtgcagcgccgagttggccttgcggatgacggagcgggactttttgtacagggccggcttccaaagcggcagcccgaacggatgtgtctgattgagggtctaagcaccggagcgcaaaatcatgcaggagtgtcgtcagcgcgcaggaaacacaagcacatggagtttggttcctgtttgtactcggctgtcatacaaacaacagcagattgcccactgatcacaaggtaggagggcagaacagcaggccggaacgctgcgtgcacacagcagccactaaaaggaattagccagctccaccgcgccgactgccagcaccctcgtcgtcatcgccatcatcgtcgctcctgctactgctcctgctccagaagggaacggagataaaggggcagtgggagggcacggatgaaagtagatcgctcagagcactagggagcgggagtcgagagaaggccaaaaaaacgcacccactgtgcggaagcacagaaacaaaaaaaaagcaaccctgttgtattacctcctgtctgtccttgagggtcagaggctccgcatcgctcatgtcgtcgtcgtcatcctctccagagtgtcgatcatagtgttcacgaccgtggtcttcatgctcgcctccgggggacagccgcgttgaccgtcgggagctgacacgtcgtagacggccgtgactgggatgagtctgactgaagtagtcgcctgcctcgtcctgctgatcctcgtcctcgtcctcgtcctcgtccgatgatctgttgcgctgtcggatggacgatcgactggatccaggcttccttcctgctgctggtctcctacgtcgactgcctgcgggcgatgctgtctctgggttcagcagcgcggacgagtggcggtatgactttggccgcctcagggcacttgcgtaggaagtcggggcgctggagggcggtctggagccagaggtccccgtccctgagccgctcgcgccaggagcaccctgcgagtgcacggggtcctgcgggttgtattgctttacggtggaggaggaggcattggagccaagggaattgatggacactctgcgggcatccttgtttaatgaagacggtgggtgtgtcggcgcctgctggagatgtgaggtcgagtcgtcggcattggcagccaagagttcctgcgtcaggtctagatggtcgaggtcgtcgctgggatggtcagccctcgaatgggacattgcttgcagcggttcgacacaggacagcggggtcgagaagagagagcgagagagagtcgatggcggcgacggaggagcagagacggtcgcggtgcgcggggtgcggaggggcgcggacaggcaggagcagaggctgggcagtgggcagggtgaggacacgaaggcagagagagactacgagaacaagagcgagaacaggaacgagcgtgcacacgtcggagaaaacgagagcggtctgtccttggccagtggggggaggcacgagtggctttgccttgtaggccacaccgtggtcattttggtcacccgaactgatcaagtctcaccagggtgaagaagggcgctggagaggaccaagaccaccaagacgactgctgggcagacacagcgcgcgggagcttgccatgtcaggttcgactggcgagagggagctgggcccagcatgtgctcgtgtgctggctgtagtggacgcagggcactcctcattctcaaccaacaatctaaaaagctatgaatatgccagggggcaattggccacccttttattggtttcggtcgcaatgtattgcactacgctgtgcacgctggttggtcctggagaagggtgagggtcggtttgagtttggtgtgcgattgagcagactccacaaagaaaaagtggggttttgcggccttcggaaaacaatttctggatgcggatgtggcaggtcgcatggacgatgcaaccataaggcggggtaggtgggtgcagtgcagaactgtctatggccaagaggctgctcccgcaggagcgacgatccactcgaccgccaccaggcacacatgcctgggaccctcctaccggcccccgcagtccaatcagccgctgctgtccccgcaggcgtgcccaccccacccgcaccgaacccacttccagacgaacgactccagtttttttatttcggtattttgtgcttacccgcattttctgattcgatggctcggacaagacctgtcgtctgtggacggcgtttaatttagatttttttttttaacccttttgtctgttcacaatcgacagcatccacatcctcgtgcactctcattcgcttcgacttctctctctccctctcactctcactctccactctcactctccactctcactctccactctccgctctacacccgcctcttcccttttgctccccacaaccatagaccacccctccgcctcatgtcgtcaccctgtctttggtcaaggtcgaggcatctcggcgctctccgcaggtccttcacaagcccccatgcgatcagccccatcgctgctgctgcgcatgctccctcccgcgtgcggcactactccctccccgcactggctgcggacgaagacctcaacacagtagcctccccacaaagcatcaaagatagagtccaggtactgcacatgcagccatggggtccgaggcaatgcaagcggacgccacaaaagagtcatttcgactcgactcgaagcaggggtcttgcacacctgctcactcaactctatccctttcacggactgctaggcaaagatcgctgcgatcgaccaagagcggcccttttccaacgtcctgacagacaacttttcgaggcagcatacttacctccgcatctccttgaccgaaaagtgcaaccttcgatgtaagtcgacgctggaagaacggatagtgcattctgattgaagagtatactcctcttggctttttctttgcaccgacgctgacagttgactgttcacttttttaggcacgtactgcatgcctgcggagggcgtggacctttcacccaaggacgacatcctcaccacacccgagatcattcgcatagcccgactgtttgtgagtgagggcgtgacaaagatccggttgacaggaggcgaaccaacagtgaggaaggacatcaacgacctcgtgggtaagcgcataaagcaaaatcaacgtttcgtccatggcggacctataaactcttggtctcgtactcgcagtatcaggcagttcgatcttcagtggtgaccctagagttggatccagcgctccgccgcctccacacctgcttcgcacttgacagatcggatgtacgcccaggtcttcggaaaaaatgtgactcatgggaccctgttgccctaacattccttggtcttttgttccatctttgttctctccgcagcacaacttggcgagctccagcctatgggactcaagacgatcgccatgacttccaacggcattgctctgaagcggaaattgcccagcctcgtcgccagtggcatgaatctgctgaaccttagtctggataccctcgaccgattcaagtttgagttgatgacgcgcaggaaggggtttgagagagtcatggagacgattgatgatgccttggcactaggcatgagtcctgtcaaggtcaactgcgtggtcatgcgcgggaccaacgataaggaggtgctggattttgtcgagtttacgcggaacaagaaggtcgatatccgatttatcgaatacatgccgtttggaggtaagctttttttttttcaaaggaaatacctatcggctttgcagaccactaaacatatgattagggatcaagatcaacaaaaaaaaatgcttacatctttccttctatctcaccctttcattactctcgtttttttttctgctgtaggcaataaatggaaagagaacaagttggtaccgtatcaagagctgatctcgaacattcaggccgtccacccgacgttcaagaaattgatcgacgaccctaacgacacctccaaagcataccatgtgcccggatttgctggacaggtcgggttcatcacctccatgtcggatcatttctgtggaacctgcaaccgacttcgcatcactgccgatggaaacctgaaggtctgtttgtttggcaacactgaggtctcgctcagggacatgatgcgccagggcaagaccgatgaggaacttcgggaggtgattgagatggcggtcaagaacaagaagaagcagcatgcgggcatgtccaacctcgtcaacatgaagaacaggccgatgatcttgattggcggataaaagcgacccaaggaaggaaagggggaagggtccgagtctgtcttgtatgcaatagagccatggcgaagaagcatggtggctatacctggtgtacagagcaatcctcaaagaaatacacttgtacattattacatcgagagcagcattgtaggtggtcatttgtttcagtccatccacagcttgcaagcggcttgagtatgcgccaaagtttatttgcaccgccatggacgttttgaaaggccctgtccgtaagcagtaacgtgtgcaaaacgtgtgaggaacgtgctgggaaccctttttttctcgtttaacgaaaagatcatggcgcagggaagtgttgtcatatcgctggcggaggattatagtagcagcgtataccagtcccgagccaattgacccgatcgctacaatgatagcaatggctatttatgtgcgccaaaaaaaaaaaaaagacgcagctcaccaaggcacagtggtgatttcggttatgggctgctgccaagtggttgtgatcggatgcgctgagcattgtctactggttgagccaagagaaaaaaaaacgcgatgcctaggcattcccggtaattttttgacgcaaaaggaggctgaaaatgctcattggggtttggtatatatagacttggcaatattggcactttcgcaagcgacgcgtatgttcacttgcggcacagcgaaagaaaagaaagcaattcctcacgtctgtaaaccgacagtgaacgttcattttgatgatcgtttttgtttgtttttttgaaaatggcgttgcagaggaactgtgtcttggcaaccttgtctagcgcttgggaggggagggggtatcctgctgacacacaaccgctctcacacgacccaggtcctaaaatggagattgtatgtgcgaaagaaagttcccgcctttctctgtactcacacacagacgcaggcacacacatgcacacacacacatacatactgtagacgccaactctaaggagaatcaaaaagcgaaaaggaccagacttttatccgagatcaaacagctttttcgaaaaaaatgtttttaaaactgaaacgtttaaagtcaaatatcagtgatgtaacctatcgatccccctacctcgtccttccactcatggtttctcatcgagtgtttccgagcttcgtcgaaacgaaagagtctagctttcttaagcacacgcgaaggagaaaaaaagaaaaaagaaggccttcaatgcgcgtcatgcgagtgatccaagtctcataagccgtccatgtgaactgtgacccgtcaaaagcaacgctactctcgagtgttgttgtgtttgttgttggtgttgctgttgttgaagcccccgtcgtgtggagtaagcgatttccaagaacaggtttgaacacagaacacaaaacacacaacaacaaaagacagagagagacgtgggttcagagggtgcgtcatttaggatttacgcgcagccgcgcaactgcgaggtgcagggttgaggaaatccttcgagaagactaaaaagctcagtctaggggtgttgtcctccccccaccagaaaaaaacgaaacgaaacgcggcgaaggcgccacgcctgtcttgagcgcagctgccagttgacacttttgaacgtgcttacgtctcttggagcaaaagttggcaggctatcggcaaagatgactgtagctgttggatgcttattttttttcgagtctgacacgagcttttctcgtttacgctcctggcaaataggggggccggtggagtttttggccctagttgccgaaaaggacaagccgcacggcatgaaagaattcccggcaaatcaccaccggccgagggggatgagcgaagaagaccgtcggagatccacagggaagaaaaaaaaattaatcacgtacaccgtatgcaagcccaattgagcaccaaaaccgggcaaatcgatgccccagatagatcccagagatcagaaacacctcaaccacgcgagcgcgagcgctgttggcactgctgagtgaaaattcgctctcagacaccccgctcgcgctgtggcctgtagaatgcgggaacgggttcgagctcacatagcctgcgtgcgtatgagagacaagcgaggacccatggcatggatcgggaaggggtgctgggacaagggcacgccaacgcaggagacagtggcgggacaggtcagcgaggggtggacgaaccgccatccatacaacagagaggaaaacaaacgcaagcgagggtctgtccttaggggctgcaaacatcagggccaggtaggtggcattactcatgcattggccctcatgttatatttagtctctggcctgccgatagtggcttcggttgctccatggctcaagcgaaacatggaaatacaatcgactcgaacggcagagacggctattgaagcgaaccacggagacagtcgtggggccgggtcattgtgcatggcccttcaaggccgcaaaagcgagggaaaaaaataaagtcgcggactactagtagtagtgctgggtaaacataggaaagcgggtttgcgtgtgtgcaagattgttgtttttgtcgttttttacaaagtccgcaatcgcaaggtggtggtggttcgtcattgcgatcgtgcgcagactgatgaataattcaccggtcaggctcgactcaattgcctgctattgtatcggggtcgagtgtccaagggtcttcatattcccgaaggaaacgggctcgaggacacacaagcacacaaccctttataaggcagcgaggtgcgcaccgctcatcttgtctccccatttctcgccgttgcatcgcttacatcacatctcgacatcacgcctcattcctcggtcaccattctgtcatctcctcgctctctcttattccccatctctctctctctctctcacactctctcttctcactcttggtcacttgtctcctccaccgttccttctctcgcccccccctctctcagcactgaaggctccttcgctcgcagcactgccttctcgttctcgtttccctgtatgcttgggaaacttgacacctgatacctctaccctcacgatataccaccctaatacataatcagccatgctttccgtcaccaacgtcaacatgcggtatcgcaggatgcacaaggcaacgaaagccgccgttgcctcgacaatccgacctctgaagaaccaccaatacaccctctacgacctccagtacttctttctctttgtgctcttctcattctgctattacatcatggataagcccgtgtggttcaagttgcctatcgccttgggggctgtgggcctcttgattcccagaaagactcgccagttcatgctccccttcctggcgatcgctgcatggttgatcctcttttactgctgtcggtatatccctgcagcatggcgaccccatatcttcacctcggttctcccagcacttgagaacattctttatggcggcaacatttctgagctccttgcagagtcgacgtcgcccttgaaggacctgctggcttggatgccctatggagtgctgcactttgcgctgccctttatcactgcagggttgattgtgtactttggccctgctggcacgcttcctgtgtttgctaggacctttggctacatgaacctggccggtgtgttgactcagatcctgtttccctgtgcccctccatgtaagtacctcacatctggtactcgatgcttggatggttgctagcctcgttcgggggtgtttgcatatatttttttgttgttgttgtgatgaagtgtcgcagcgtgtgattagctggctaaattggtctggtcacccaccgagccacccacccgtgctaatgcgctcaactgttttttttctcaaattcctgcagggtacgagacgaactacggcgcctttgagccggccacctatgcgatgcccggcagtcctggcggtctggcccgcgtcgacgatatcctcggcaccaacatgtacaagtccacgttcacggcatcgccccttgtctttggcgcattcccttcgttgcactctgcctgcgcctggcagctggccttcttcttggtctttatctttggcccccgctccatcccctttgctgttggatacgtcttttggatctggtgggccaccatgtacttgggacaccattacgtcgtggatctcgtcggaggcgctggctttgcggtcgtcgccttcttcatcggctcctttttcttgccctcggtcttgcccccacagcaccacaacgccaaagcttcccatgtcatccatgacctcggtgatgccatgaactaccaggagaagcaaacgctcttcaacgactcgaacgacaacgacgacgactttgttgggttcaagaaggacacggaatgggacctcagtgagggctatcaggcagaggaggataccgctgaggagatcactgatgttgtcgttgtctcggttgtccaggaggttgaggagcgccagctgttgtcacagtctgcaccggcctcccccaccgccagcttgctctcgctcgcgcccaagaagaacaccgagaaccgccagagctggaacggatggcagggttacgagtcctggatggaggtgttggccaccgttcactcgccccgcacctctcctcgcacctcgcccgccagctcgcctcgcaactctacaacgcatgctcacggatacaatggtcgccatgtcaacagccgccgtttcagtcgcgactccatgcactcggtcacgacacttaacctggacctagaggccaatgcggcgtacgctcaaggatcgtcgtcgttctcatcgccactggcctcgccctcgaagcgggactcgttcctgggcatgacagccgtgccgatgctctcgtccattgaagagaatgcagagagcatcgccatgaccaagggccgctcccgccccagtcgtcttgtgcttgagcagactctggtggcctcgtcatcgtcgtcgtcgtcctcgttgcctggcagccctgcgctggagcagtatgttgagagcgaggctgagtctagccattcaggcggctcctcgcggccgacgtctccccgctccatgatcactggagcggcttcaccggccctcggcaagcgcttcaaggacgactaagctgcgttgcagtgacacctcaccacgccctcaccctacacttttgcctttacataattctagtcagccacccttgtaccataccactatgcattgtataatataattgtttttttgtcctcagatccacaatgcgatgtaagccggcgaaaagagagtttggggggcaaagcgctttttttttctctctgctgaagacactgggcgatgcaaagcgctgagcgcgtttttctctttataacaccatgttgacacccttttgactcccattccgttgtcgtctcattccttgtttcctccgttccaccatccaccctagtcaccctctgcccacgcgcgtcatcctcgtgtgcctctgttcactcgtgctcacccgcccccaccacgacgctgccctgtcccccccccccgtcagcctgaacgacgtggggctccctgccacgccaagagccaacctgcacactgctcgctagcttggccgtgcctgcattcacgccaccaaacccattcccggtcgcgttccattcccagccgccatgccgctgctcgactcatccacgcacgagttctcggacctgttccgcccattcttcgaggactgtccgcccgaggtcgaggctgcggcatccatccccatcgaccagccactgcccacacagtcggtcgctgtcatgccactctggccggtcaagtcgcccccgcaggactcgtccatcaagctgctcaacctcgaccccaacacctaccccgacctgtgcaggaccgtcgccggtgacttttacagccacacacgcgatcgcttcgactactccatccagagcgtccacatcctccggaacccgcttgtgtggaagcggtaccaagccgagaagcagctgcggcgccagcttgctcaagaggagcgcgaaaagcggaaacaggcccgagctcaaagcacagcttcgcaagcaacatcaacgtctgcagcgctgtcgaccccaccatcatccgcgcaagacgatatagtcaacctggagcccacggagctgttccgggatgaggtcctgttccatgggacccataagaagcacctgccatccattctcctcaacggactggatcccaggacaaccacccgtgccagttacggcaagggcgtctacttttccgactcgattgaaaagtgcacaggctacatcgacccccaagtgtccatggatcaggagtactcgatcatcgtgtgctgcgtcctgctgggcaacgttttcgttgagccctattcgaaaaagactctccacagtcagaccatgttcctcccaccggggtacgacagtgcagtcgcccacggcctgtttcaagagtggatagtgtgagtccccaagttccgttgtaacactgcgcaaaaaaagacgtggcatgaagtgtgcatcgacggttccaaaaaagtctttccactaactcatacaccctggtcctcattcttttttttggcttcaaaacaaacaacagctacgaaaagtctcaaatcctgccgctgtgcgtcgtcaatttcaagacgacgaataggcctgacagctttttccgccttagcaatccagtggtgctccttcgcggtgcatccgtctacccttctggcttcgaggacgttccttcaacttgcacggtcccaactcctaccgacgacagctcggactctcttactgttgctgagcgcgaatggcatagccccgacaaggcaaaggaacaactactgtcagaagtcttgaatatacccccggcgacagtccaagtgtgcactgtcggaagggcaccgcataaagtctcgtactttaagcacctcgacaactcaggagcagtctcggctttcagtctctatgacaatcagatggaccagctgaaggctgcgtgcttaaacgtgcagatactccaaggacggctggaccaggacgtgcggagctcaatctcgtacaagaattcccggacgacattcattgcggagcagactgccagaatctgggatggggagcgtctagtggccctcttgacagaggccctcccagagctggaacgcatccaggaagaaggcaagacagtgtcggcggagcttgagaaattgactgcgagcgcattgcagctcggcagaacggggatgcttcagagtcatgagttccgtttggcagcacacccctatcaatcgcgcttggcggagctgaaggcggcgtatgatctcaaagctgctcctctcagcaactggacggctgagcaacatcaagccgctactctggtgcgcaaggaacgccacgacctagagctttatgttcgcgaaaacgaggccaggcacgaacgacagaccgcagccattcaagtcgagaaggctagggttggtcagcaggctcgtggcatgatcaagcccttgacagaggcagaggtagagaagcgcagaaccgaggcctctcaagtgttagtggatgcgttcaagaaattctcgctcaagctgaaggaagtcgacaccagcacggcccagatttggccccaagtggtcgcggaggtgcttatgccttggttgatcgtcaagcaacttccctatgagaagcagcagcacctgaacctcacggagccccaaaagacgcccttcaaacttttgggcgtgaactcgactgtggtcccgtttaactggtgggacgtgaccccaaacgcagcttttgagcagctcatggcctcgcacgagttttggcccatcgacccacgtcggagattgcccaatcgccggcttttctacatcaaggactatatcgagtggatcttcttggagcgggagagtcggatccggaagcaacagcaacatgcactccagcaagggacatcttcggacacgttggcggggctcgatcgtgcccagttcatgcaggagcagtgggccacgctggacccgtgcattctccagtccatccaagggctttcaagccgcggggggctcgttgttttcaagcgcaaggagcgtcaggaagagctggacaagatgggctcggatctgctgggcgggctttttgtcgacgcggaagaacacatgctcatacgcgatgaggctcctgcaccatcggcctctggaccaggagcctcgaagctaccacctgcagaatgcccgatatgtcaagaagagctcgtgctgtctaaacctggcgcccaccctggaggagtggctccagagaaggtggtcaagatcaaaacctgtcgccattgctttcacgaggagtgtatcagtcagtggtttcagtcggccggctcccagctcaaatgccccatgtgcaacgtcatgtgctccactaggagtgggaataccaaggcgatcaaactaggaccgatgccagatgctgtgatgggctatagttttgatgtccggctctgctgctatctcatctacattgtcgtccccgcgcataccattatgacagacggtacgtccacctcggtgaagacggaccttcgatgggccattgtaccgttctcggggcggctgggacccttgctcatgatccggctgatatgtctcttctattacgggcatttgttccgtcatggccgatcactgtcccggaaccgagataatgtggtggtttggaatggcgtccacttgaggaccagcatggtgggtgcccatggatatccgtccccgaactttgagatgaattgctgggacgagatcaatcaaaagggcgttgccatggggcttgaccagctgattgtgagtatgcctgtgctggaggagaagacggcggctgcgttggtaccggcagagactcggaccttggatggctttgtgatgcctccggatttagcggaggaattggcagcacaggatgcgatggagagtctgtttgatggcaggcgacctttactgtttcgtgctggataaatgcgggaattttctgtctctttttcttgaaaggttgcccgtccgcatgcaatttctcacatttcatatttgtatatttcaacacactccacaataaaaacactccccccccctagtcctttttcaggcgtttattctttgtagggttcgttcgagcgtggctgccatagcggcgagtcgttcgagcatggactgcacatccgaatcgtccgagccacggactagacctcgttttgcaagcagaaggctctgctgtgtctgcgagggtggctccgtgaccgttgcgacagctcctctgatggctcgaatgttgtccagcatctcgcgcaacgaccgctgtgtctcgtttagtttcctggcttcaggccccaaacctggaacggcaggggggaaaatgacagaaagtaggagcgatagatttaggactggcatgttttccacgttatggtcaagtgatattcacttatgatagaacttgaagagaggacggcgtgaatttacctggaatggtatcctgaagctctgtcggatggtgctgctgctgctgatagtgttgcagacgcgaggagatgtctttctcaaagtcgtgctgaaaggtctcgattgtttgcaagagttgctttgtagccttgttcaaggctgcgagactcgccacatccagccgtagtgacggtgaggagttggccaattccaagtcctgtttttttttggtggcgggtgccaaaaagaatgaaagggagagagatagtgagctacagatcctttttttttttggtgggtagtggaggacctggcccactcactcacgcactggtttacagtcactttatatacctttgtggagaagagtccgagttcctgttgcgcgttgtcgagaagtccttgcagctctgacaggatctgggccagcggtctttgctctgggtcccgtgccgcctgtgcgtgctttgcttgagtgaggagactgtctgagaagagttgaattgaatccgtcaagacggattggtgccattgtggggttgagatgagcgtgtccatgagacggcaggctttgattgcgtctccacggctgcttgtcgcgtggggggcattcatggcacaagcggattcgagcagagagggagaagagcaatagagaaaaaaagtgacgacccttgctcgagatcagatcaagggcactctatctgccagtgcctacctggctgatagagagtcctttcagtcactgggctgaccttttgtttcatgccatacatccttcagtctccttgtcaacgacactctttctcttctccctcttcttcttgctcttcctcttcctcttcttctttgcactagaacgctctggttgttgtcgagatgaaaaggcacaccaacgtcatgcaccctaccgccactgcagctgtagctctcactggcctgtccttgcttctgatgtctatcaacctctgcactgcctcatcgagcaacctcctgccagacttattccgccctacctttgagtaccctgtacggttcaagttggaccgtcaggagccatattcttctgaactggcagctcgatccttgtccgaaccttgtggaccagaggaatgctctgcgatgatggagccagtcgtggtggacatgcccttgacagggatccccaaggactatggatacactgcaacgttctcgattggcacctacggcacggatgagcaggaccgtctctttcgactactcatcgataccggctccgacatggtcgtgctcacgtcggaggattgcatcgatcccgagtgtgtcaaagtccctcatcggttcaactgctctgcatccctgacgtgtgccccagtgatcaacagcctgacaggcaatgagagagcggttcaacgatacggcgatggcaccaaggctgagggaagactcgttcaagacacggtgcgatttgttgctgcagatccactgaacgaactcgacaccaccaccaccaccaccaccgccgcggctagggcaagcacagggctgacattgctaacacaaccgatgctgctggtggatcaaccaggactacgactgttcaagagctacgggtctgcggtcgatgggatccttggcttgaacctcggcagtcctgtcatcaccaagactgtgatccaaaatttacgaaacaagactttgacgacaacgacgaccttatcggacctgccatcatcctcgaccttttgtccatcgtcctcggcttcgttgtcgtcttcttcctcgtcttgtttggatcacccgttttcacttcaggactcggccgctgagagcatggggttcatgagtctgtggctggggcattcgtacgaacgcggccaagggggagagctgcttttgaatgcggtggatgcctctcggtttagcggtcctgtccactggacggaacggaggccgagtccttatgactggacggttcctttggacaggggtgtgtggttactggatccgatgagcggccaggcggaggcgccgttggtggggagtgcacgtagctttggagtgatggattcgggatcggatgggatctatcttgagcgatcgatgtacgatgcgctgttccagaaggtgccgggggcgaggcggttggcggagacggggtactggcgagtgccctgtgaggggacgatggagctggtgtttgggatccaagggcagatgtatcggatcccatatgcggattgggtcaagaagccatcgttgacgatgatgacggagacgacgacgacagagagtgcgaatgcgacggtgaggatggagcgtggaattgatatgtgcaagtcaagggtgtatggcagttcgcgaggtccgattcttttggggtcgacttttatgaggacggtttatacgatttttgacttttcgagacctggacaggagcgcgtagggttggcgagactggcgtaagagggaggtcctatatcctatacatacaaggaaggcgtgctatgtgcatctggcgaggacaattaatgatgtgggtggggtcatccattctggctgtttgtctggctttgaggaacggggaaaagagccaggccaatggagtccttcgatgcgctgattggacaatatccgaacaaggttctttagtcacatggatcaaggtacgctgtgcaagctacgcgaaaagggcatcccaataaaaaaaaggcctgtggagtttcctggtggggtgtcttgttggagcaatctaagctggaggtgctgggtagaggccataaagggatgatctgcattgcaccgtcctctgggtgctccttgtcccacagatggaatcagggccgccctcctgtggcgatgaaaggggactgcattgatgtgtgatgcgctctgctggcgtgggagaaagtgtgggcaagcaccaaattaggaaggtacctctgtttctcccacgcaaagtctctttttcttcctcgccttccttctcgcccttcttgccctgggccgtggtccccgcaatttagtgctacagtaatgctagcggttgggtggccagagtgccccatgatctgccttgccccctgcagttcgggcgtggagaggcaaggagaggcgaggatgggatgagggtcggtgacaggtgaatgaggatgcgcgcagtagagacacgcatggtcggtgtgtttgttccgtcgtgtccgtggtgtctgtctgcccaccggtccacgatgtgggggtgtctcctcctgcccccatccacacatgaagcaagacatgaataacacacgttgtgtgtgtccatcctagtgatggctgtgtcccatataaagggctgcgttttactcctttttccccgtttctctttcctcttctcttctctcttctcttctcccctctttttttttcttttgccttcttgtatcctcttctatttgcccatcttgtccccctctcgccatcatccctcattcctctccattcctcatttccccatcccgcctgtccattcctttttgcttcgcttgtgtttgtcgtgtctgcgtcccccctttgccatatagttgtaccatacatagtccagccaccatgtcctctcaagcgaccctggccacaaaggtcctgccccgtcttggcgctggcagacgccatctctcctccacgatcaagcgctccatgacccggcgcacgctctcctcgtcctctgcagcctcagccaagacctacttcccgcagtcctcacccgccatccagcagcaggcccaccctcgccagacaacccttcatcagcagcagcagttccaaaaacacacctcgacctcgctcaacccttacaagtctattgcgatccgtcgtgagggcaagaaccgttgggagcgacgtgctgccttgacgcccgaggctgtcgagaagctcatcaaggagaccggcatcaaagtctatgtccagcccagcaccaagcgcatcttctcagacgacaagtaccgtgccgctggcgccaccatccaagaagatctctcggtcgcagatgtgattctgggcatcaaggaggtccccgtcaaggacctgatccccggaaagacctacgtctacttttcgcacactcacaagggtcagaagtacaacatgcccatgttgcaggatgtccttgacaaggtaaaaaaaaaaaagaccttgcctcgttcaagatgttttcgctggcagtcttagatgcttgtttttcgcatgtgggtagactgacaactcactctttgaacgtccacggctatgcacatcttagaaaatccgcctgatcgattatgaactgatggccaacgagcaaaagcagcgtctggtcctctttggcaaacatgccggatacgctggtatgattgacggcgtccacggtctgggtcaaaggcttcttggtcttggctacagcagccctttcttggtatgtgtcctgatctgacgtcttgaaaagtctgaaaatgaacaacggttcacaaaaaaaaaaaaagctcgattgtgagcaacgtcattaatttccatgtttctcacctttgttcatcgcagcacgtcggtatggcacacaactacaagacgttggcctctgccaagattgctcttcagtcccttggtaacaccatctcggacgagggcacgcccaaggagttcggacccatgaccttcattttcacaggaggcggaaatgtttccaagggcgcccaggctgtcttcaagtcacttccccacgagtttgtggaccccaaggatcttcccaagattgctaccagcaagagtaagaactgctgtttgacacgagtactcgacaaagtatgcgctctcttcaaggaattgtacactgacgctcgcctgcgaacgttctcttgctgtcatagacgctcgcctagaccgcatctacgcagccgaggtcaacattgaggatcacatccgccacaagaccaagaacgtctttactactgctgaagagtactttgctcatcccgagcagttcacctcgacattccacaaggatgtcgccccttactcttccatgatcatcaacggagcctactgggacccccgctaccctcgccttatgacaaccgagcaactgaagacgttgcaaagcgatccagccaacaagttcagaatgctcagcgttgcagacatctcgtgcgacatcaatgtaagcttttattgacaggctactacacctacgcacatgcatacgcggcctctccttttcccttttcccttcaacagggcggcattgtttaacccatcctttccaaatgatccttatttagggttctttcgaattcatgtctcatgccactgccatcgaggatcccttcttctacttcgacgccatcagtggaaaggagcacaagaacaccgaggctcctggagttcagatcatatctgtggacattcttccctctgagctgcctatggagagcagccagcactttagcgactctctgtaccccttcatcaaggaattggtaaggagttttgcaaagaaagagcttgagtgaaacccgactcattcgaatgtagtgtagtaggctaatgcgtctcggcacgatctggaactcccatccactagattcgtgacaaccacgcccaccctgttcttgccggcgccaccattgctgagcatggctctctcaagcctgcgcacgagggactggccaagattctcaaggacactcatgccaaagagaacctgagcaagatcaagtctgccctcagcacccctaccggagttcccaaagcgaagaatgtccttttgtgcggatcgggctttgtggccggtccccttgtggactacctcttgagagatcccaatgttcacatcactattgccagcaactctcagacagaggccacgtcgttggctctgggcagagccaacaccaaggtcgtgcccttggatgtcaaggatagcgccaagatggcatcgctcgtcaaggattccgacattgttgtcagctttgtccctgcgccgttccaccccatcattgctgagcactgcattgcggagaagaagaacatggtcacggccagttacatcagcccagccatgaaggctctggacgagagggctcagcgcgctggaatcaccatcatgaacgagattggtttggaccccggtattgatcatctcagcgccatgaagatgattgacgaggtcaaggccgagggcggcaaggttacttcctttgtgtcttggtgcggcggtctgcccgctcccgaagcctcgaacgtgcctctgagctacaagttcagctggtcgcctcgcggcgtgctgactgccggtttgaacgatgccaagttcaggatgcacaatggtttccacgaaattgctggcaaggacctgatgaagaagcacttcccagatgtgccaatctaccctggcttcaacctcgagggtgttgccaacagagactcgcttagctatgccgagacctatggattgggccccgtcgagaagctggacaccatgttccgtggaacccttcgttacaagggctatgccgatctgatgtattccttcaacagactgggacttttgaatgccgaatccagccagcagggctttaacacctgggtatgtgtagtcgcggggcgacatttattgtttatgcctaacgtgtgcaccccattgtatgcagccattaacacaattgtttaccttgttcctttgcttctgattcgcagaccgagttcatggacagcctgttgttcagcaagggatcgacccacgacaaccagtctcgcacagcagccattgctgaccgccttgacctgcccaagaaccaccccagtgttggcaaggtggtcgatgctctccagtggctctcgttgatgcctagctccaacaaccaggcggctgcgttcactgccaaggactcaacgacgaccctggacagcttctgcaacctgctgatgcacaagctcaagtacaaccccttggagcgcgacatggtaattttgcaccacgagtttggtgtgcagctgaaggatggatcagagcagacgcgcacgtcgacgctggcgtcgtatggctcgtttgagacgtacaccgcgatggctaagacggttggcctgcccgctgccatggcgacagagatgctgctgaagggcgagattcccgagaagggtgtgctcgcacccacgatgccacatgtgtacaacacgatcctggataagctcgaccgcgagggagtgtctgtgctggagcagattgtccagaagggcatgcggcccatgctcaagtggggcggcagcggcgtattcaagtagagccgaggaattttccataccatgttttttttcacagcatagacagacagacacctttcatcaatacaacttttgtagaacatcaccaaagacttttctgactccccttgagtctattctttcgtcctcgcattcctcgcattcctcgcattcttcgcgtttcgtctcttgcaacttcctctttctgcatctgcacttgacagcaacatcgacttttcatcatggctatggcagtaaggacacccttccgcttgagctgcgacatccactcgcttgatcgcacatccttcagcaaagcaggctgcagccacgcgcgatttcaaggggtgcatcgcaagggaatctcagtcctcttcatctaaccagcttgctgctacttctgaaccgcgcctctctcgtccttgcccatcgcgtcactagagtctctttgggctgtccgccccactcgacatcgacatccgcttcaatggacaggaacagcggaagcagatcgaggccaaagtagacaaggacaggaaagaaaagtttccattgtactttgatggcgagacggtcgcaggaaaggtaccgttcaccatcatgcctcccacacacacccttttcaccctttattttaccatacgggcacattcagctgccatggaggacgaggcgcacgtttggctcttgcccctgccagcaactgggacgcgccattcattatggtagatgtgcgctggtgcgtccggcagaggagggctgtctcaatgcagggctgttgcccgaatgagagtcgacagacggaacgcgaagtgctctcgctctgctcgacaatcccgaaggcttgcgattttcttgagctctgtaccttcactgcttcggcggctaaacatcggtccttcgatccatgggatagatcaacatcagagtcaaggacggcaagaaggtggagcacaatggtgtcaaggtcgagtttgttggaagcataggtaacgttttggcctctgagcaaaatgctcggggggggggggtatcttgagccaactggagttttgctgatgatcgggtctgtctcatgtagctgtgttactctggagtattgaagcagctctttatgcgttctgatagagatgttttatgctcgaggaaaccattacgagttccggacgattcaacaggaactggctgtgcccggcgaattccgcaacaataccagctttgatttcgaattcaagaatatcgagaagcaatacgagagttatcatggagtcaatgtcaagctgaggtatgttgagaatgaggtgagaaaaaaaatgcgggatgacgagtgctctcaccttttcctaacggacgatcattgtccccgcctcgatatacatacaattttagatactttgtaagagtgacggtgatgcgtcgtttggcagatgtggtgaaggagcaggacatttgggtacactcatatgtgatgcctccagatggcaacaactcgatcaagatggaagtcggcattgaggattgtcttcacattgagtttgagtacaacaagtcgaggtatgagggacagtgaacatcatttggggcttcaactttcttcaaaaaggtcaaaggagccatgactgatgccattttatgcttcatctgggaacgttccaggtatcacttgaaggacgtgattgtgggcaagatctacttcttgctggttcgcatcaaaatcaagcatatggagctttcgatcattcgacgcgagaccaccggcgcgcctccaaatcagtacaacgagagcgagacgatcacaaagtttgagattatggatggcgcgcccgttcgtggagagaccattcccattcgccttttccttggggggtttgaactgacacctactttccgcgatggtacgtgacaaaacgtgaggcgcagcttttcatctgtgtacatgcatcatcaagggcgctttgctaatgaagatgagtttcgggtttcttgttacttttttttattgccagtgaacatgaagttctcggcgcgctattatctgaatctggtccttgtggacgaggagaaccggcgatactttaaacagcaggagattaccatcttccgccgcgaaggtatcaaaaacgaaatgacgagacgggccatgcgtgaaagatggtttgcgggttatttttaagtgcaagaccctaaggatgctaacgtgtcatgatttccgtcttggttctgctttacgctttgtgtagtagacgataatgttgttgagggcccagcacagatccaccaagtctgagagtctgagcgagacagcgaaaaaaaaaatgactcgacagaagtgttcaccttttaaacgatatagagaagtcttgctgaaaaaaattttgcacaaaaaaaaggctagtcttggatgagtgatctgcatatcaagagttcacgcacgtaccacccgtgctggctactgtgggacgtggtcactggatgcaaacgtggtttgttgttcttcgggtcccagatacctatggcgcatctggaacatgctaccgagagacaaacccgcgtctggggccttcaagctttttcataggcgagtaattataactgaaaaaaagtgcaagtgtagggatgcaggtatttaagaggaacgccaacatggcgatccaccttttgatcttcaccactcgaccgacttcttttctcttccgctacacagactccccctcccactctacgcaatcgcttccaaaaagacatatcttttccatcatgaagttcgtttcgattgtcgctgctttgctcgtccccatgaccgcgatggctgcggttgcgcccgtcgccaagaaggatcatcacgatgcccacaagcccgtgcacgctatggccagcaagaagggtcagttgtacgtcaagttgaaccgggccacgaatctgacggacaaggattttattggaaagtcggatccgtttgtggagatgtggctcgagaagggttacaagcagcggtccaaggacacgaaggggttgaacccggtctttaacgagacgttttgtttctatgtccgggcgggacagaacaagctgtatgcgcgtgcggtggacaaggatacgttccgcaatgacaagattggtcaggcgtccatttccttggaccaggtgatgaactcgggcaatgttggcccccaggattatgatctgcccaagtggttgggcctccggagcaacggaaagctgaatctgcagttgcagtttgtggaggacacttccgcctaaaagaaggagaggtgctttttctcctatccgatagacataataaaatcgcattagtcgtaatagaaaccacttcaattctttttcctcgttcagtaagacacgtcgctggacgcggcttcttgacctcatccccagtttgatatcacgacgacaaaagtcatttttgaccctctgtgggtgtttggagagatatgatgagagtggagactgtagcaggtgctgcagaagcggcgttatgaaagctggcaccgtgggctacctggaagccagtggatcgttgatcggcaacaaatttccaaacatcgagtttcaaaaaaatcacgtgcagggtagaggcgacttttgaacctcggaggctcttgatcactctcccctcacccattttccacgagcaccatgcactcattcgcagcactcacgagaagggcatgggtcgcccgtccgaccaatgtctcccgggtcagtagcacggtgtccattcgactctcgtcctcggttgcagcgcatgtccacaggaacccagttctggaaatgcaggaacgaggactggtggctgccatgacgaggtaaccaagcatggaagcggtgcctacgggttcctccaacgcctggctggaaatacatatgagcaggggtgtttatggctgtcgccaacataagagatgatgcttatcgacttgcgtactcggcctcatagtccggatcttgtagagcatgtcgaggcaggccccacggctatctactgtggtgtcgatcccaccgctagcagtcttcatctcggaaacctggtgacactgttggggttgctgcattttcacatcaagggccacaccactatcgggctggtaagaaaaaagagcttcttttattggatggccctcgtttcgggtttcccaagggatcaaagatgctcacgtttttttttgttgttttctgggtcttgttgtgtcttgtctttgtcgcgactttgataggtgggtggtgcgacaggatcgatcggtgatccatcgggaaagagcacggaacggcaaccgatgtcggctgcaacacttgccaacaatgttgcaggaattgacgcgcagttccagcggttcttccaacgtggaagagcttatgctgaaacccgtggttacgccgttcaagggcatggaggcaaggtcaaagtggtcaacaacaagacatggtttggcaagttgtcggcgctggatttcttgggagatattggtcgctatgcacgggttggaaccatgattgctcgagacaggtaaaagagaaagaatgacgacaggaaggatcgcccccccccccccccccctcctccccctcttgtcggtgacaaaacgagagttgagaaaccatgacgattttgaggaggagatgtgttggctgattgtgctgattttgttcttttggaaaaaaaaaaaaaaacgaatagtgtcaagtcgagactggaaagtcctcaaggtatcagctttacagagttttcgtatcaattactgcaggcatatgacttttggcatctgttccattcagatggttgtcgcatccaggtaggtggatctgtgtatgaggcaaagagaaaaagaggaaaagggttgtttctttgccgttcatgcattcttcgcagtatgaggcaaaagaatgatggacaggaggggttctatggggtttgttctttggggtttcatgcattcgcacagaatgatgtaaaagaccgaaagaaagaggaaaggggttctatgtgttttttgatcgctgtgtttcatgcattcttacagaacagaatctgctctcttgttctgccaccctgttttctagctgggaggaagtgaccagtgggggaatattacggccggcattgatctcatccacaagaagaagaacacctccaaggagcaggtcctcattgaccacagcaaggaagaggaaacgccgttgagcgcgtatggactcaccatcccgttgctgacgacggccacgggcgagaagtttggaaagagcgcaggcaatgcagtctggctggacgagaagatgacgagtttgtttgatttctaccaggtaaacgggccttgactcgttattgctatctctgaatgccgttggcccttgcaactctgaatgaactgtaactcgtcgtcttgaaaagtgagctgatacaggtttctttttccctggtttcttttccatgggttccagttctttgtcaagactgcagacactgatgtaggacgctaccttcactactttacactgttgacttcggatcaaatcaaggatatcatggatcagcacagtgtaagacacccgcccggcttgagcagggttgcaaggatagtctttgaggatccgatttctgatagatgttcttgttgatccgattagttggaacccgagaggcgacttgcacagcacgctctagcaaaggagaccacagaactcgtgcatggaggtaaacttacctccccgaaaatacggctgcttcgggaaaactgttgatcttgcggctttagcgttcgagatcacgatctctttcttacagtcacgtcatactgtgtgtacctcttgccgctcactctagctgacgcgctgccaaaggcattgcttgcaacacatgttttgtttggatcctcgctggacaaagtcaagggtcaagatcttatggaagcgttcgagcatgacccgaggatggtggctttgagcaggtcgcaagtctcagggatgagtctggaccagattgcattggagactggactgtgcagctctaaatgtaaagggcaacgctacgtgttttctttgatttcgcgtcgattttcttgttttgtgcacttgagagtttggccagatcatggcgttttcttttgttttttctcactcatccctcttcgtttgtctttttatattagccgaggccaagaagctgatcaagtctggcggattctatatcaacaatgtgaaggtgacggatgcctcgcatcgcattggtgaccaggactggattgacggcgcagtatgcgtattacgatctggaaagagtaactacaagctcattcacgctgcgtcaagttgatagaggtttgtcactcttgtaagaaaaaaccatagaatcaggcaagagatagaacgaaaggggagaaaaaacgagagactgttccttttttttcgcagtcggtaaggtgtagcttaggcttctttaagttgattaggaggccatgtccttgccaaggcagccaggggccatccttcatctcttgcctcctcctttccacgatcgcccacgacgacccattctacgccatccagggccttgtgctggaccatacccgagatcctgtaggcgttcgcgagtttcacataatggcgttggaccgactccgagatgtcttcggccgcatcgcgatagctctcggatcgttcgatgaaccgagccaggtttctggaggcgatctgggcggcttcgaggatcgaaaagacctggtggacgtggatcatgcccttgtagacctcgatccggaccagtttgtcggggttgctcattccgagttcgtgggcgtaaagacggttgtcgtcgacgagacggtcgtgtgtgcccgtttgctgaggaggaggaggaaggagggaaggaaaacgaagtgaggacgccaatcgtcagtcagtgggaaaggagacccgatggatctgtatcatgaccagagctttcttttttttttgtggaagggggcaaggggcggggcgccacacttacgatcagggtgttggtcaggtccgagaggtcggctcgatggacgggcgacaccagcggatgctgtgccaaatgcgagtaccattcccactcgcgctctttgccgagtgcgttgcgagcgttgggcacagtggctgcatcgccacagaggtagttgcgtgcaaagtgcagctattgagaacggagcggaggacgcgttgaaagtgtggcgggtgggaggcacgagagttaatagtcgcccatggctgcgtccacttgagagcaagaaggcatgcttctggtggaagacagacagagagagagagagagaaagagagagagagagcgagagcgagagtggattgcacaaaccttggtaaagttcatatatgcttctttgtcaaaaggggttgtgcctatgggtccggggcagaagcagtacgagtcgctgcagctggaggacggcagggacgaagtgggatcagtccaagcctttgttatggtgtaagaacaaaggttagtaagacagagaggtggaggaatgcgggtttcgatcggacagggagggctcttcaatcagcattctgaaggcacttaccgagagcaagagctgcgcgtggggcaacacgtactttggagtggtggagggctggacataggttctcatatacaacatgaacgcagcggccagattgcctcctgcagagtcacctcccaccacaatatcccgtgggtcgacagggacatgatgtagaaacgactttttcttcttgtcaaaggagagagcctcgtgtttcggctcggtcaagtacagataagccgcaaaggcatcgtggatagcggcggggaaggggtgctcaggagccaatcggtagtcgaccgaaaacactctcgtgcccgggccaacgtcctttgcccaatccgccaagaacttgcgatgggaggccggtgagaggaagccgtgtcctccaccgtgaaagtagaggatgacggtcgtggatcgggcacgcgtctcgttctttttggatgtggcctcgatccactcgcccttcaccgtgaacgatcctgtcgagtccagagcgccgacctcgtccggtaaattggcaagttgagtttgggttcctagggagggtgggtgcatggattcaaagtaggctggagtcgggttgaggagacagtcgtcgagattgcagccttgctcctgtagccggtttcgaacgctggcaagggtggcgcgttctggtctcaggaggacattcagattgactttgaactggatgtccttgctgaccttgatgtgtcgtgtgtagagcatctgtaacgggatagcgcgctcgataacttggcccacgaagcgcagctggccgatggtgcgtatttcaggggcgacgatgcggacaagacccatgaagatagcccaccaccatggccagtccagagggtattgttctgtgttgtacttgaaccgggtgacgatcagaaacgggagctcaaagccgtgtaagcggaccatggcccagacgcccatggcgaccacgcgtgccagaaagacgatgtcgcgaggtttgtgaaggatgccctttaggtagactctggagaggagtgagggctcaggaaagcggcgcttaggttgctttcgctgcactggatggttgattaaggttgtggaaggggcgtttgtggcgccatccggtggagagaggagggtgcctgttcgggtgtacaacgtcgctgcttgactggaaaccatgtctgcttcagagagaaagagagggtgaaggacagaggtgatacggagagggaggtgagagagagagagagagagagagagagaggactgatggaggaaagaggcaaggtatctgtttttctcgcgctcgaccaactttcctgttatttttgcttcaaggagattttgtctcggctggtacaaaaacaattggggggtttgcgctccatacacatgtgcagagcgcgctctcctcctccacgccccactcccttcttgagtctctttaacctttgtcccccgcccctgagccaggtcgtatatatacaaggtaatttttgtttagagctcggatgtcggcttctgaatgtgcgggttgcgcctcggctacactctagtgttgttgcagttatccagcctatatcgcaagtctcataagtcataaacagggtcaaatcctgctgcagtggatcaaagcgctttttgcatgtgcctaatttttttttctcgtgtttctcccttcccgcgcttttccctgtgtcgcagctgcttgatagccaggtcgtccaagatacgcgtcgcccatccttactaaactgccttctccgagttattccctctgcaaaggtgatgtcctatttgaaatagatgtggatcaggcccttgtctctcccatcttcagtcttgtcagtcttgtcacagctaagttgccacatggatgctgactgcacagttcatcccgttggcttttttgctcaatggtcgaaaaaagagacgaaggatccgaggaggagcctcccggggggccgtgcacttttttttttgacagtggtatatcacgtgctgcaatctgagatgcgactcaacacattcgtgtgaatcgttcgattgtgccatccaatcaacacgcgaaccaagcaagactccatccgacgttctagcatccatccccagcagaagcagccagccagccagccagccagcattccaagtcctttgagcactagcaaccatatcctctcgagcaataatgtcatccgtcgaagaatccctgttcatttcccagttcctggctgtgtttgcaggccaggagacaacgttcccagccgactatatctcgcctggtttggcacccaactggacctccaaggtagagagagcatactggagtactatggctatgttctgatgagcttaaggtgctagaactgtagtagctaacgactggcggtatgcttttcgactgacaacccttttagagggccacctttgagcgaccagcgaaaaaggcgaaaactgaggcttcccaaggaggtaaatactgggcagcgattgtttactgtctatgagagtatcccggggactggactgaacggctgtactgaaaggtctagtagctgaaaataactgaaatcgtatgaaatggtattctagatatccaagtgacaatcaagtcgttaaagtcgggtcagtggactgtcgatgtgtctgctcaaggaactatcgccgatctcaaggaggcattgcaggccaaggcagggattgacgccagtagccagagactagttttgaagggaaaggcgcttctggacaacaaaagtttggaggagtatggcctgacctctggatctgtcgttcatttgtttgccaaggctggaacggttgcctcacccacgacctcctccacctcgcccgcgaccgctgcagtggcatcttcttctactgagggcgaattggcatcgacatcaacctcgggagctgcatcgcccaatgtcacttcagccgttgcaggcccaacagccgccgtcaaacgaccggccgtgacatcgtacagaggcctgtcagaagcgggcacggagattgccagggatgcggagttttggtattggctcaatgatcagctgaaggagcgactaggttcgaaggaagacgcgtcgcagatgatgaagggctttttgggccagtaccgagatttgattggcaatgcaggcacaaaggagattgagggccaaatcaagaagtgatgaataaaaataaaaaaaggagcggcgagggttgttcctggaagttgttgaacacgtctagactgtttgcggtttgccttgttgatcgctgaagggctgcctttgtgtcatgtgtaaataaagcttgaggcattttttctttttgcaccctgcgtattcaaagttttgtattcgacgcatagacggagatgcacactggaccctgaccgggctgttgggcggcggtgttgctatgagaaatcaaagaccaagtgtgaatgcgggtggaaacagagacaagataataataacaatagtgataatggtgcgcgttattcgcatgcgatgcagttggtcaaaaaaaaaaacaaaccctgacccaaacaaaaaaacgcaggtttatttcggaaggaaggttgcgttccaatcgttctcgatacccatgggtcttcagcccaacccaaatctcgctgttcagctattctccgaattctttttatttttttgacaggtgtccaactgattctatgggacgggtgcaagaatagccggaaggaactgagcgatgggtggcaccagccacatatccagccactcttggcgtggacaaaccttcttattcaaaggtattgtttgctgcaaggaggaacaacgttgttcaggttttgatctggagcttcgatgctgctaatagagctcgctttcatctcaaaaggctcattttttcttagccagtagtccgaaggagaaagacagcataagggatgggagccctggaccgtgtgaggggtgtgtggctgcaattgaatcaaaaaagaattctatcgacgcagcggcagggttgtctcacaaaaacccaaattggcggaggtctcacgactcgcgtacttgcacactgtggagagagtttttttttaatggttgtcaaggttcaggattacaagctgatagcaagatagtgtgctctcctttccttcgattcattcggccgtgtgtgtgtgcagcagcgaatcaggggtgcatgcggcgccgatgaccgagccaggtactgtaccgcaaaggcatgtatgtgtgtgtgtgtgcactgtgtggtgtgcgcacgcacgcatcactttggcgaggaaacgtgagttgagagagtgagagagagagatagagagagtgagagatggcgaaggagtgttagatgcaaggtttgtgcatcaggcaatcttgcgcagttgcagtccaaaaagcgtggtagactactgtataaaccacaaaaaggagcggtgctgcaatattattaattctgcactaaacacgaactgatttcgatcgaggagtcaacaggggacaattggggggggggggggacagccctgtccagatgtcgagaaaggaccgaatatattaacaggccaggccggactttcgccgtatcgttgctccttttggacagggccatgtcctaaataagcatcaacggtggtaggtgaacgagaaacgagacgacaacaaaaaaaaaaaaaaaataaagggctcttcgactacagctacaaaaggacgtgaggcatgctgcgacgaagctgttctcagtcgagctttattttttttttcttgtttggatgcattgctgatctgcgttcatcatctctttcattctgctccttgcacattccttccgttgtctcttgcttccttctttttgcgcaaacatacaccctcacagccatatctatacacacaaacacatacacatatacgcatacacagacacgagcacatacacagacacgagcacaagcaccagcactgctaccaggcaagattaggaagaacgagcaagagcacagacgaggcagacaaaagagagagagaaagagtgaaggagagagtgtacaaagagagagagacaaaagagagagagtgtgaagagagcgaaaagggagagaggaagagtggacgtgccttgggatggcaaggatgcctgctgcccgttttccctccatgtcttgctcgatgtctcggactgcagtctgctgcctctatgttattaactctttttttttgttttctctctctctgttttatatgttgcctacgtctttcacctgcctctttgtctctctctctactctctctctctactctctactctcttctctcttctctcttctctcttctctcactctctctcttgtcatcgtgaccctttgtctactgtgcgaccctgccacctggtgcgccaccgacctgaccgtgtctgcgtctcgcacattcgcccattgtctgcccaactgcgctacagtctgcgcattccgcttgcccatggtcctctagccagccactcgatccacaccactccacaccactcctcactctctctctctctctcttctctctcttttctctcgtctgtctcgtcactctggtcactcttgtcactctggtcattgtcgtcactcttgtcactctggtcactcttgtcactctggtcactctggtcactttctctcgtgtccccttctcgctctctctctctgtctgtccgtttttgtcagtcagtcaacacaacctcggcttctgcaggaatcgcctcccacagcacagcctgacacatcatgtccaaggacgaccacaaggagcgccagcgggtcaccaaaggtaccgttgcactctgtcccgcaggaccatcgtcgcatgctgacatggcctttggaccgaacaacaaaaaaaaaatgggaaaggagcaggcagtagcaaacagcaaaccccgcctcggatcatgcacaaaacaaaagctaatcctgatgcacctcctctgctctctttgtctctctcgctctgactgtctgtttgtgtgtctgtgtgtgtgcgtgcgtgtgtgtccaacgtttagcctgcgacaactgtagaaagtaagtgctgcaccttgccaccgccgtcatcacgacacggtcgatctgcgcctgcaacagaaagggagaacaaagtgcatcgacgactgaacgtatccgcatctcgaaaccgcgacactcttgcgcgatgcaaccgcccctctgtcgtctgtcgaggaccgatggacttgcagatggcgctctcgcagcgctctttccgatttcccctctgtctcctttctttcgatggctgcgctaaccactttccttccttctcgcgctggctctaggaaaaagatcaagtgcggtatgtcgattgcagctgcatgatgggctcttgatgcccgatttttggaaactgcgccttctcgagaaacgcgtccccttttcagtctcctacagcacttttctctctggctcaacccctttcctagcctctgttctggtccacccctgctttgatttcattctgtctcttgtgtgtagacgagcgtataaagatgtcctcgcagctaggaagcacagaaataggagttttctatgatgaaaccaagcagcgcgaactaaccgagggctgacatccttactcacttacagatgccaaggccgacatgtgctccagctgcgaacttctccaaattccatgtaagtgggcctggatgtgcagagcagtacgccatcgaacccttcgagagggggggggggagggcgtatgattgtctcatcgcttactgctccattccattggaataggtcaatatctggaccctaccaagaaaagaggacccccgaaaggcgcaggacgtatgttcaaaaagaaaagaaaagaatgcaccaaagaaaagacacctgaacacggcccgactccatgcgactaacagtaattgggtggcatccacacaccgacctcttctcaaatcgcgctctaggctatgtcaattcaatcgaggatcgcttgcatcgtatggaggccatggttggtggcgtcactgaggatgaactcatgactgtatccggggatgacgttggaactcggccgaggagtagctcatcggcatcggcttctggaaaaccgaggcggcgaaagtccaccaagggcagcgcagacaaaccggcaaagacagtaggccagaagccaaaggcggacagcgacccacagcagcatccacatctgctgcccgactaccagcatccacatcagcaccaacatcagtttcagctcgaaaactcataccagcatggccaacagcagcagcagcaagagcagcagttcatgcagggacaaatctcacctcatcaccatcaacagcagcaacagcaacagcaacagcaacagcagcagcaacagcaacagcaacagcaacagcagcagcaacagcaacagcatcaccatcatcatcatcatcatcatcatccccagaattcacttcttgacctacaactggaatcaagtcaaagtccagatatgatttcccaaacgcattcggacgacatgcatcgtataatggaccctcaccttatcactccgctgcatcaagatctcttgcgggacacctcgttcccatcattcaactctccctcgcctctcctcggctctgagcactctgtcaacgagtacaatgacctttcacctcgtgcagacacactcccgtgcttgggcatcaacacacctcctattcatgacctcgacgaccttggggaggatatgggtcacctgacgctggatcacaaaggacacgagcgctacgttggcaagtcctcgcccatgttctacaatcggcggcattggggtggatattcacttcgcgagcgtgagctgcctgaggctcgcaaatttgttgataacccagatctgccgtcaccagaggtcatgacaaagctactgaacctctatttcagctatgtccatccctttgcgcccgtctttgtctggtcaaagtttttgaagcgcctccaaacgcgcgattactcgccatcgttcctgtttctgttgaacagcatctttgctctggcatctcggttttccgacgacccggccttaagaaccgacccttcaaagccagagacggtcggagttcgatttgtggagaaagcaaaggcaattttggacacaatctatgattcgccggacatgtactgcgtcggtgctttggtgctgctctcttaccagcaaatgggcacgggagggggataccgagcatggatgtttattgggatctccattcgtatggcccagcatcttggactgaaccgagattgcatgaagctgaatccacacatgcccgccctggatcgtgaagagcgcaaccggatctggtggacatgctttgttgcagatcgaatcgtctctgctacctttggcaggccacaggtaataatgattgcaagacttttctcaggcgttatacatcgagttctccgaatcttttctcaaacgagtattcttcctcttcaacgacgttatagggcatcaacgagcacgacgtcgacgcaacctatccagagggcatcgacgaggaaaacattcaactggagtacagtctggagggtgcggattcgatcttgacaggcccttcgcctcactcggagaagaatttcgtatacatggcttccttgacaagaatcatgggcagggttatggttagcttgtacagtccgctgtccagggccacatccatgtcaacttcatccatgacggactctgcaccattagagcaactggacaaggaactgacggactggttactgaccttgccgccccacctccagtttcgatcagttcagcaagaaccagggacgtttgtgtgcaccctgcatatgaccttctatgtgactctcattctgcttcatcgaccatacagccaccagaccccatacaacactccaaacgactcttctatatcgttgtcgatctgcacttcggccgccaacaacacgatcgagatggccagtaatctcatgcgggcttcggacgataacagggatgttcctcgcctcaagtgtcttttgcacagcgccgtgttcatcttcttcacggcaggtcttgtccacatcacaaactgcactagtatgaatcccgttctggcggcgtcggccaagctacgcacggtagagacacttcgatgcctctctattattgaggatgtgtggatcacaggaaaatggtgcgggaacaacatcaagaatcttgtcaaggcgcgcaacattgagcttccatgctctgtcgaaggtacttttgctggcctgtgcacatgcacacttgataccatgcaaccctaaatctaacatcgtcttcaaaatctcatccgtataggattcaaacacacgttacggaatggaggaaatgcagcctcagctgtcgacgacgttcacccagcacaggttgacattcctctagcaacaaatgctattccaaaggatcagctgttcgcatttgacgtggatcagatcatgggctattatcaggcaccaggaatccgacacgcggagcctcaaggccgcaactctcgccatttctcgcccacaccgtatttcagccccatctcaccgcaccatgcacagaaccaggtgaagtcgcatccaggattgacgcagggccacgcgccgcttcctcggcggcctcgacaagccaagaacgcttcggtgtcgcctggaagttccgtctctggagcagcctcgaatggacccatgacttcgctctcgaacggaagccagtcggtgttctcgacatcgcaggcagataatttggggacggggatggccagtgcacacggattctactcgccagcacccacagatccatttgccaccccgggctctgcgaccatagtgaacagcatgcagtcgcaaccacagcaacagctgcggtcgcaggcggccgctgaaaatggaggatcacgcaatatgtaccagaacccgttttcgtatactgtctggaacttgcccacgtccatggacaatgatgagtgggtcctctacatgcagaacggaggagccgtcggcgctggtctcgacgcgaatagtctttctgcaatggggatttcgagcggcggcaacaactccaacagcaacaccagcaacaccaacattagcaacagcagcagtaacaaccataacaacaacggtggtactagccatactaacaacattcaagtcaagatggaggatgggcttttcaagtctataggcgatcagacccatacctcgcccttgttgctggacaacaacgcagtgaacttgagtagcatgaatgcggatagcagcaactcgactctgggcaatcggatgcaccccttggcacagagtctgacaaggaacgaccttttagatggggtgggcaacatgaccggtggaggcggggccagcagcgcgccagctcaaccatcgtctctgtcacaactctctcaactgtcgcaacagacgcaaagacaacaacagcctctcctgccatcgcaaggttcagagtatgacttttacatgggcggcgccaatgaagtcgcgtctgcggccgttctgcggtcgcagaccactgtcgcccctcatcactggaactcatagcggaaaagcgacttctttttttcattttcttgcgcatgcatcccaccctgtacataacttcttcatatcaaaaaaacatgtctttataaacaaaaaagaactcccttttggcactagtcggcatatggatcgtagagctcggtggattgcggcggtcgacggtccacatcatacaccggttgaaggtggtcctcacgaccactcatggcagcaacacgactacgccacgatggcagggcgctcggctgctgacggcttgttgcgggcgtcgtcgtcgacgagaaggacgcgactgaggctctcgctggtgagctctggaaggatgtctcttgatggtgaagatgctgctggtggtgctgtcgagatctttgcagtgacggatgctgttgctgctgctgctgctgctgctgctgctgctgttggcgagtggatgggtcccgtcgttgaaatggcagttgaaggcctggttgtcgcggcggtaattgaggcagagtgatgccctgacggtagggtcggtatccattggaggaaggatagggccgtgcagagacttggaagactctgggtgaaggcgtcatgttcatggctggatctgtcagcgacgagccttcctgctgcccttggcctggtgatcgtgtcaacccagggcctggaggctgtgagcgatcgccgtggccatgaggatggggaagcgggtggaacggaggagggtggtggtggtgatagtgatggtagtggtggtgatgaggtaggtggctgtactggtgaggaaaatagcactcgccgcaccgtggtgttgactctcggtgcgggtgctgtggaggggggaatggatggctagggtgataatggcggtctggtcgggaggcgataccggggcaggacgcaggcgagcagtgataggcggttggctgctgatggccgacggggtgctggtgctgctgcgggtggtgtcggtgctggcattgaggagcagagtaccgcctggcactggtgtcggcaccacctggccttccttgttgctgtggctgcggctgatgatgtggccctggctgtcctgagcatccgcattgcattggtgtcgctctgaagtcgccgagtcggttggtgaatgtcgaggtcgcgttgacgcacggacaagactggtggacatagtcgggtgggtgagagtagtacactggggcggaggaggacaggtgatgggaaagcgagaaagaggaggaggaggatggaccagcattttcgtgatgggtggggtcctcgtatctgccttccaaaggacaccagagggactctcgttgatccgtgcgctgtccttgatggccgtgtaaaccgtgccaactgccctgttgctgtcccgttgcgaacgatgctcgactgcttgaggatgaggaacggcttgaaggcagcgatccgtgttcggggctttgatggccagcgccggaactggagaaagtcgaaggggcagtgtcttcagttgtcacggcaattgtggaagaggatgcggtagagctgatgcttgtccgccgtagcagtcctgacatcccagatcccatgcccattgtgccggtctccagtgcagacgttcgcttgtctgtgagtcgcatcccgcactggtcctctgttgacggcatgactcgatctgattctgaggtcgatgctctcgaatcgtccgagccctcggaagtgttctcctgaaagatccgtgccctagcctcggcatatgccttctcccgttgctccagggagcctaagcgaggttcgagtccagatccgctgcagcgtgcctcacatacactcacgggccgggatgaacagcgtttgaggaccttgacgggcttgaacagcggctctccgtggtcttcttcgacaagatcacagaatcgtagcggtggactattggaatgaaggtgaacaccagcagcaggagagggggtgccagacggaagaatgggcgacgaggtctgcgtgaggattctgagaggacgactggcgtagagggcaaggatgggtggggcgcgcgagcgacttcgttgggcgggtgcagatcaggacttacatggccgagttctcggttctggagagggtgattttcttcagcagcggatcgaccttgcgggccagttggaagtagatggctgaccgatggatcatcatccgatagtacgagttgagccagggaaactctaaagcgtcctggctgcgaaagaccatgtcatagacgatgcacggaaaacaacacacagaaatttcgccatttttggtcatcagtgtctgaaccatccgcaggcgataggcgataccgcagcgaactccactaccacctcacttgctcccatctctctctcactttggccttacctcgggttcgcaatgaagttgcaaaactctcgatcgagcttcagcaagaacaagcgttcctgccggctcttgagagcgcttatgagaaactcatccaacaagcccgaggacgggctcattccttcctgtgattcagactcatcgcatggacagtcactgccttggacgatctgcagtgagctcctacaaaggctcgccaacgagtctactgtatctcccgtctcgggggagccgccggatggctcaggatcaatcagcgaatgcggtgttgaagttgttgtgttgtcctttccagaacataaggcgcttggctcactcatagcgggcatattgtggatgaacccgttgatcttcttgagctaaactaatgtaaggtcaggattttttttgtcgtgggcggtggagagtggagaggcgtcagccattatctttagtgccattttttttttgctggaggtgtgaggcaggtcaaaagcccaaacggggagggaggggttcaattgcactgcccgttgcagaggccggacgtgttacgtgatgcacagaacttgcatgagtgatcatatgtctagatcatgaatgaatctatctcgtttacctggttcaggtgcttagcttgagacgtgctaggttcgcacaacttctcttatggcagtcgagaagttaggcaccgcacgcgaggtggtaatggaataacggtcaatcaaagacaggaacccccgcaaccaaaaaaaaaaaaaaaaaaaaaaaaaaagaaagcagctgaagaaagggtagaacagggcagggttggccagggtctgattgacgcgagggttcatacaaccaagctaacctaacgaagagtgtttaagcaactccgagacgaggactggcctgacttatgaggcagaccaagggttgaggagcgcgaagggaaagggacggtttgagtgcggtatgaatggaaatacatcccccgttcattgggccattcatggagaagagcgtggaaggaatgagattgcgagagcgggctatgctagcgcgagagaaggggcgagtatgaggaagagacacgaaaaagagaaaagggaagaaagaagagaaaaggagggcagcaaagaacagcaagacgataacgaagtgagagtgtgaggtgtccgaggagtgatcagggatacattcagcgcgagcaacagggtttgcgcccaccgcgcgtggcaggacgactactgtatatagtcacccaaaaataaccccgaatgcgggtgacaagggagccgaggaaggaaatcgaaggacgaggaagcccgcgccgactgagaatgagcaattgaggtggtcgacgctgcggttacagctctggctgccgcggttctctatcgcccattctcctcccttgtgctccctcgctgggggaggacccaaacatgaagacgtttgcctcacggaagaacaggggtccgatggcagaagaaaatgtggagaaacttttttttttttttgttcgacaacgttctatgcgcaaacaactttgaagtccaaagttccgttcctatcgctctactagctccaccatctccattcccgcgcgaaattgctcgcttgctcggagtgagccaagggtgcagaccgtagcaatcggtgaacgactattttgctccctgcgagggacaacggtcaatcatcgattttctgggtgccaaagtattctttttttttattgtatccagaagaacgtgtatcgacagactgcagcagaaaagtataaaaagaaagaaagaaaaaaaaaaaaaaaaaaaaaaaagaaacagaaaaaacagcaaaagggaaaaaaacgacaagcaattgcggaactttgaagatgaaagtgagcgcacagcgcgtgagagtgcttattaaaatatacatataggtagtagtaatgatagtgataatggtgatggtggtagtgatagtggcggtggtagaggccgtatggcgagaagcactgtgtgagctcaactgaagacgccgctccactggtcatatcgggctacaatcctctgattctttcggcagtcctcgctcttagaagcccatagggtggtgatggtggtgatggtaaggatgctgctgctgcgcctgtccctgagaaagatgctggtgctgatttgggtgggcatgagggtgagggagctggtgtggctgatgatgggacatgggatgcatcgccaacggatgtggctgcatgttcgtaagcaacggatcgcacatctgcagctgaccctgcgtttgctgctgatggaaggccgcagcctgcttggccgcctcctcctctgccttcttgtgctttctccaggcctttcgtagctccttaaattctgtaaaggttggatcgcaagcagaaaaagtcgacgcgttagatatcaacttggaaagaacgaatgggtcatatagagtctacagtagggcttagtctcaaaaacgtacctgaaggatgtcttttcggtccatgcttttgcatgtttacatgagcgttcaggtggttgagagttccgtagctcttctcgcaatcagcccagttgcagacatagaggcgctcgatctcgtcgaagcgacggcggggtctctttttagtattgacgcccgataatggcacgaatgagtacaccttgccgccattctgaccatcgtcgacgcccgtcatggctcctttgggaagccacgcagaaccagcctgctgttgaggcgtcgagtggtgcggtggcattgactgatgcagcgagtgtgggtatggcccctgggatgggtgcgactgaggatgttgctgaagggtcatagcatccatgtatccaaccagcggagaggatcgcaccattccctgaacaggcacagaatttacgcccaccatacctccatgagcaaatggatttgccatgagcggactagagccagagttttcaggactggtcaggctggtcatcatcaggcccgagctggtgtcgatcgaaggcacaaatggatacgtgacacgacgaccatatccctgcacattgacattagagttggtagacaccattgcgtgaacgggcgatccgtggcggacgaggttcgacgaaggcatttttgagggatcgttgctcccgaactgctcttggacagagtacatgctgctgactcgttgaggtggaacgtctcccaatggcatttgagtatagtagcccactggcggtgtcgctgtcaacatgctgttgctactgttgttgttatccatattgctcatgacttgctgtggctgtgcgagaggcgagcactggctgtttctgtgaagtgcctctgacaggggtggcagatgaaatggcgcagaggatccgccgattgaattggcgtgctggctttgtgcgtcctgcgcttgtggctgtgatggatcccaggcggcggttgacgcgtgagaaaggtcgatcgaagacactgctgtggtgatgtcttcagagagcgatgatgagttgacaccggggacggggtattctgccctggattgcaaatcgggggactgtggcatgtggccagactggtgctgttgctgcttttgctgctgctgatgttgctgctgttgctgctgatgctgaccgaccatcagggactgcctgcgctcgtgaatggacggccggctcagagctgcgtatggattttggtttcctgaataagatccctgcgtcatgtactgagtggactgtggcgattcagcctttacggggctgtaatcgctgggtggatagtatggtgcttgatgcactgactgggaggcaggctgcgactgcgatggcaccatggcttctatagtaggacgtacgggtgtgaataagtctcgcatcaatcaatcgacacagtgccatcattgtgtaggattacttacccagtcgaccgtctgaattgtggtgaggactagcctgctgagagtggataggttctgacttcacaagagcgccgtcgtcagcagcgaacgccgtagttgacgtggacgaagacgtccactccacggatgaggcagttgagccgctcgtgggcggtgtcgaaggggtcaagtcctggtcgtgctgtgagtgagttgagctaatgctggaacgcatttccgcgtggaaggggaacgaagacgtgggctcgatttgcaagggactgcagattgagagcatcggatggctctgtacgtagcgctaaagatggtggtgttgttcgtgttcgtcgacactgacttcaggtcccaaaaacgcgtcgactgctatcgttgtgggatgggtacgcgctcaactagttgcgcaaagaagatcacacgtcgctaatagaggtttcggtagtttgaggatgaggcgattcatcaacgcgaagcatcaacgataacgtgtaaggttggtcaatgagttgaaagggaaagagagaagtagatggtttattaatatgtgaggcagttgatgaggatgcaaggcagtgaacgcgtgtgttaactggatcttgccacaacaacatttgaaccattgactccgaaggtctgaggtactgaggtctcttttctccccaaacttgtccctccttttcttctgcctgaatatctttacgtcattgagaagggggaaggggaaggagaagcaggtctgagcgggaaaaggtggtgtatgtgattgtaagaaaggggaatgcgggatgccgtctgtgtgctgatcagtggtcgtgatgattacgattacaaggcacctgaagggcagagatagagagatacagagaggaatcatggtgtgctggtccgtgtcgccgtctgtgaggataaactgggcagtaccgtgtctgcaatgtgcaatgcgtgcgaagtgggtaaatactacacctagtgtgtgttcccctaaaatgcacttacgttttaaaatttgtgtaccaatatttccgggtctacttgatgttgagaattgtcgagttctctgactggattaaagaagccaaacggacagcagagttagagttggtctgtgaatccagctgcaaaggccgtatcgcacacaatagcaatgtctgcagtgtctgttgcaggatgctatgagatacgcgacaaggaagtgtgcatggaggcaggaaacgtaaagaaaaaaaaggggataaggagacgaggtggggtgatatgaaggtggaaatgagaaagggtattatgcccattgttccgtgtacgtcatgttccctttcagaccgactgatgacgacgatgaatagggatctgttacgcccttcaaggactctgtctaatcttatggcaacaagcgctatctcatccgcattggagtggtgagagtagcgtggacctcgccgttgccgaaggccgctggcgttgataaattaccaaagcgcacaaacccccgtcagattaagcggcaccatggtctgtaagtgggtgcgcaggctaatactacagctcgatatcggtagcagcgaaggcgcgagcaagccccgcgaggcaatcgttggtgtagatgtgtgctggagggcaattacagtaggaatatcgctatacctggtcgtcgtttttaaacacgctaaccaattgatgggagtggaggttgaggcgaaatagcgtcgtgaagtcgtgaagtcgtgggccgagactattagtggtgcgtgttttggatgaaattgagtagtgggcagaaacgaggatgaaggcggactgatatgtgacaaagtgaaagggttgaagactgcttctggaggttcacaacgactcgagacaagagagagagaggagtgggaggtgactggaagcaggatacaaaaaaaagagaaaaaaaaaaaagaagacagctggatggctggctggtttatataagtggatggctgtctctttactttcaatacagtttttactttgcttgattgcagtcgatgccaggaacaagcagggtgggatatgcgatatgcttgacaaaagggcatattgtttatagggaaggatggtccggcactctattacagtctatattacagattttgaataggattgaattgaagccggcgatcctgttcatacgatgcaacgggacacagcttcgacacctcatgcatttctttttgggttggcatgtattcaaaaaaaatccaagcatgccaatggtgtccactaccatcgtcctctgttcctggcgcctgccagacctcatgtctgcgtaggtattatgaagcaagaagtatgaatgtgcgcgagaggcattgaaccaccgtattgcaatcgagagaagttagagtactgtagcgactgtatgtgctgattgatatgtagtttacatgtatctgcagcgttctgctttacagtactgtactctgttacaaggttttattgcaattacagctggcaagtggggagcgggcgagtgagcagcagaacgacaccaagaaataaaaatgttactgtatccagagtatcgtcatctctgtcaccaagctttgagagcaaatccacctcaccccttccacatccaccaacaggaagggtataattgccctgattctctgcccagtcgggtgaatggaagctgctctttcatttgttttgcctttatggttatagtgaacgtacgttgcagctttcgaaacggtcatcgttaccagggccgatggacgtgtacaacaaaagggaggtttccgacatcttcaacgcgattccaaaatccgacttgtgcaccgtgagagtgacggagatgggcggtgaattttttttatggcgttgacagacccgagatgagataacattccggtggactccccttcatatgactgctgttactgctgtgttcggctccgctcaggtcccagcaccaacccacatccatggcacatagggccgcaaaaaagaaagagagaaaagaaataacccatggacacatgcaggcgcccgcagctgcacgcatcgcaaacaattgagcgagtgactgagatccttcgcagcgagagaaacacgcatagactacaaggtcgcattccacatctgtgatgcgaacagctcgaatgagatgactttttgagacgtgagcctactgtgtgaaaaaaattggcaacggtgacctcataatgctctgctttgttggctacactgagaaccctgtccgcgagccgagataggcaagaacaaggttgcgtgagctgtgagagaactgcgttacggccaagagtaccctccggccctcctcacgcctgtgtaccatacacacctgagcttaagacatgttaaaagctatagcggtaggtccccggcgttgagagatgggtatcaatgtaaaaggagtcgttccaacatatcataattttgctgtcagtagtcgaaaggctttaggacctgcctcacgccatggcttgaaaaacaatggatgaggggtgagttcccgctcgctttcgccctgggtaagggatgagcgagccggccaggtaaaagatccaaccgatcttttcattgcaataaaaaaaatcgctcacatccccgcctgcatgctatgacagcaccacggccaatcggttgtgcttgcttgttcgtttactcgttaagtttctgtcacaatcttgggctttgttgtactcttgagctgcctgtacgtccccttttctttgcctttgctcgttccttgctcaatcaccttgtgttgtcaattctgtggccaaaagagacaagcaacatgcgcgctttaattagcgaaggtgtccacaaggcacggcatcgcttggatacacagtctttgtgcggataagagcattcctggttattttagtaaccattcatgccgcttcaagataccctgcaccgactatcagctctgcacccgagaataaataccagagaaccggcgacgttgtcaaatgcaatgcgccctcgctgtcaaagtgacgagtgaatcaacgcttgtaatgaagtgttgaacaactgtttttgttttcatacaatgttggaaagggtactcgctgcgcgcggtcgtgcgtgcgatttttccccctcttgctcactttcttggtcttgtggtcaaagtcattttagcgtgattcttattcgtattatgtaaagaatggagaacctgcaatcgctctcactcctctccccttccactgtacacacttttctggatccctgatggtcaagaatagatctgcggtctgaaatagcgggggggctttcacggtcaatccatgagatgaagactttgacatgaaaggacggaagaagaagtccggatgagtttttttcttctcagaactgatatcaaagaatcttgctcgctggctgacatgtctgccacagagtgcacgccacgcagatggcgtgagtaggacgaaatgaccgccgaattgtttgatgcagttcgatggggtcccgttccgattagccacacatttgactctcattcacgcttgaatgctgaagtgtgctgcagcagaatactttcttcatgcaccatgacgcgaaatattgatcaaggaaacaatcagggccagcgcattcgaaacaggttggtcttcgcagggatgctatagtcaactggctttcatcgaaatacaataaataagattcgctaaatcccgaacgagctgccagagaaaccttggacaaaactcagctgtaaaaaaggcgaacttgtcgatcgatcgacggccttgcacttatggagcgttgcgcgagtgatgactatcaagaagcatggccactggctcactacagttgcttaaggcgacaatgagcacataagagccaatatgcgcctctggaggcaccaccatttcatctctctaacggagggctgaaaattgaaactgctacgcttactgcgaacgtatctatcccgccatcatcagtgacattttgccagaacgccattaccctgcaactgggagccgaataaagccctctttcttcatatgctcacaagtcccttagcgtattacatttattataccataaaaccggctcacgcagccgtataacaagggttcgcgactgctgagcatttgtgcattcgccaaccacagtggcgtcgacactttccgatcaagaaatggcagccgtttttggcgggatgtctgttgctcatgttttatgaccgtttgatctaatgaaagagcacgctagaagtaggaatggcgatccacgaaagatggccgtaattgcaaaagtccaaaaatatcctcaccctttaccgttgtgcgatgctctttcatgctaacgataatgctcaagagaaacagacccatagggataaacgcattagatcagggctggcagatcacaaaccaggaagcacctgcgtgagtccctctccaacttgcgcatgtcgttttggtgggtattggcctcgaaacatttcccattccgtgtacccaaatgtgaacaccatcctgcgatgggatcgcatggtcagaacttggataccggacccagcctggctaactcacacaaagtacgcaagcttcgtgtttatgcgcaagcaagacccgtgtgctgggtaattgtagcaagggacacatgtgccgcatcaacgaactgctcttgaaaggtgccctcaaggtgctctctttcgttttcactgtggcaccaaacatatgggtggaggtgaggcaaacaatacatttacatacgtgtctgagctgtgacagtctagtcaaaccttatgcgatcttcacgtcgttgattttcccttttttccatatcgctttgtagtaactgttataggagcagcgagtaatgaaaggagcttgcacttacggaacttgatagatcacagtaccctttaaaagtcagtaggctatgcctgagaagactcaacagaaccttgttgtgatgcagctccagagtcatcataggttacaccaacttcgtcatgctgcaggtgtttatgcctaagctgggttacttgaagagccgggggttgctgaaggcgaaggacagagaaaaaaaaaaattcacaccatccatggacccctcccaacgaaaagagctgggagggaggggaaaaacaaagaggcgcacatgaagggttgtgtcacggtcgttgggtccatgaatggacatgacactcaaaacgcgaccacgccatgactccgtttttgatcggtggtctggcgtatcatcagcgcccgtgcttcacattttacttcagctgccgacgggcgacagctgcagtatcgagttcacactgttgctgtaaaaaggaacaaaaatgatcttcttctgaacacatcgaaccaacggatgagatttccgtgcgcccaggacgaacacgacgaaacatgttcttgaaacatgatgctcagtcaagtcaacatgcaagacgagtgttgaaagagacgaatccttgcccttttttcgtggacaccgactcaggaccgatatatgtcaattggcctccaacaaatccagatcctttatggccttactaacggtggcgtaattcttgaacgatagcctgggtgccgtcgcagtcaatggactgcgcgaggccgaggcaccagcgaggcgccgcccacggcttttaaaaataaatagggtacctgtggtaaagtgacggagggattctgacacaatctttggcgcctgacggtgctcgaatgaaatctttttcgtctgccctttctcacccactttggcttgcatactcgcttccacaagtgccagcaagaaaaaagaatgatattccatgcaaaagacttatgtcgcaaatggtacttactgtcggttcttctcagtacttgacagcagatatataccgcatctcaggtcttgcacccacttgatccgatcagacatatcgaaaaaaaatcgacacctcagacagttcaccacgcaagacgcagaaaatcctgcatttccgtatttgattatgccgtctgtcagcagcaaataccattcgcgtagtgccaaaggtctgcttcaaaggtctcgtctctggcatccagctctcgtccgcaagacgctccagtcatgatgcgtcatcgctttcgtacttcatcggatggatacacccactaacaaggtgaaaagtaaacaataccaaatgaaaaaagaaggaactcccaaacgctttcactgtcttcaataaaaccgccgttgagtttgaagacacgagacaaaaaaaatacgatgccatgttcgactgccccaacttctcggtatggaggaccgtgggtctagaagcgcgtgtacattcacacgcccgcaaacacatggactttgggctcatttcatgaaagcttgatcttctcccaactctatgtagagtgtgtagcccatctaatcggaggtccatggctttacaagggtcatacacaagagtgctgcaagcaaaagtactgcacgcgatccggacattgcgaggtgagcaatgagggcaatatcgcaacttcattaaaagtagtttattaaacttttgcgaaaaaggtggtccttgtcgctcctccgacaggaaagcagagaagtataccataaccgtgtaaaacagaaaaaaaggagaatgcagaagaaacaagagaaatggactataagttcaatgcagagcggtaaagcgggaggcgcctccaatgcatctgaacctcgatggagtacaatgtggataagagggctgaaagtgttcgtgaaggtgagttggggtatatatgcagaatagaatgctgttctcgaacagcgggccatgagagcgaaaatgagaagagcagcacctgtgggaacgatgatggtacctagctcatgacctggctgagacgtttcgaaagtcaatggctctaggggcatcctcagttccctcgacaatcgcgtttcgcctgcggaacgtgtacggggtcggcgtaggacaatgactaccttcgccttcctcctcagtaccgactcgacgacttctctcggcgattctttccgtatatgtgaccgacgacatggggctgagtccatcccttccaatccctccactgcccatgctgccactcatgaccagcatttgagcagtaccgccaatagtggtaaactgagatgcttgagctgctcgaagagatgatcggcgtcctaaattgagaggtgcaagcaaaggatcggtcgtatctaaactcggcgcaactgcttgtggaggagccactgaaaaggaaagagcgccttgatctcgcaagcggtaaggccttggtagcaacgcggatttcagactgcggagcgcacgagacgacaatggatgtgagggagacagtaccagtccgccaacggaagggctctcgagcgaaaaggcagtctgccttcgacaaccggtgctgggccaggacgacaccggtactgatctagggccagacaaacccgtggtgcggctggagactgccgctttgtactcccagcttttgtggacaccaaagccgtgtgcgtagctgcagaccgagttgggcggtggactaccgcgtcggcggctaagttgatgctttcgccctgagaggcgtcgcgcctgaacgcagtgcctgcgttggctggaaggacaaaaatccttttcgcaaatcctgctgcatcgatcggccatgtgagctactttgtttcttggtaggtgtgtagtctgtgtgtctttctagtagtaggcaagagagatcagttcgatacgtcagtcctcaagtgcattgttccacactgaggtggaaagtcaaatcaacgaactgctgctcaaaacaaagtggttgcacgcaagaacaaagagccaagagcgcaactggaggctctccagtttaagaaaatctgtgatacacatgtatgtccttggcagcactcagtaagaggtggattgtatgagagcaagagaaggattacccacagcaagggtgatgaggaccaaggtgggaaaaatgcgtcagatcaaagacgtgagggctggtggagatttcgctgactttgaggaggaaagtgtatgaggtcaagggcagaatgagctcacaagttaaaggtctgcagcattcaaacgcaggtgcataggcaatgaaaggatgtggaccagcgaatgatatattgcgatgaggcaaagtgaagttgaggaaaccagagaggaagaggttgcgcgatatcagggtggatggatgcggacatcgtagccgtgtctacatcaccagtaactcctttcgcaacggtctgaccgaggaccgctacaagtgcagcacgttgagatgcatcatcccagggctgcttcggccctcgagaacgaggaagaggagggtcgcactttgaaggggcaccgaaaaaggagttcaagcagaaggagttgaaagagtgtggtgaggattcagcatgcacttcttacatttccgatgtcgttgtttgaggcgagtatcggcagggaaaatcggatgatatgataactcaagcgaggggccacggctgactgaatgagaagaggagtaggacaggatcaagagcagagtcctgaccgggaaacgtgaagacgaggaaggttgcgaaggggctcgggatcaaggggtgaactgttcggagacgaccaaaaagtgaaaagtgcggactgtgatttatgggaggagacgcagaaacgaagagaggaaagagaagcaaattgagatggtgggcatctttcgcaatgttgatatactttttttctgcttccgctcgtttctggaccatggccttacttaattgcatttccgattgatatagaatacactgcagcactttcttgtcaaattgggcgtggatacgcgggagagcattgaaagttcgcccgtcgtcgagtgcatgtatcgagaccctgacaatgcagtgcccgcgttcggtggctcttggcctgtcttcagcaaccaaaagccgtcgtgtctggcgcactcgcatgtatttgatcgaacgcagctcttaagactattcacactcgtgtgaagaggtcctgaagcgtgatcgtagtacactttggtgtgagtaaaggtgaggtatgccctaagaccaacggcgaggaagagaccgcgttcacacacgcgggacgaacagtatgctcagctgagcgagcgcactgtctttcatgcgtataacagccgaccttcaaacttcacgacacatgtcgaagcatggggcagttgttaaatgaaaaggagctggtgtccagtgtaaccatcacagttcatttccgctgctgctctcttcatatcccactcctaacactcagtcttacaggctgggtcgcacagtcgccgccgtcgcgctcacagattcgatagccctccgcttgaatttagtctcaagtactctttaccttgccctcttaatgctcctactcatagtgagccgttctgtgggaaccgcagaccctagccactctgcgaggaaggtccgcgtcaaccattgacgaacattagtgtgcacctctcggtgccatttgcgttgcagtcgcggaagtgtaagatattaagagtcgttgtccttggcaacgttcaccaccgctcctgctgcagcggttgcggatacccatgctgccatgtcgcatagagacaagggtgctcagaaaaaaaaaaaaggttcagaaaaaacgctgtcaatgagatgctctctgtttactttaccgttgttttttgcatcacaccatgcagtcttcattttcaacccatgcagccaaagcaaaccatgcaccattttttttctcctctctctctggctgcctcttctgtctgcaatcataccaatcatcgtacggcaccgcgccatcagactaaatacgcccgatggatcagctcccatttctttcgtcccgctcgtgcctgtcctttttctgaccgaaatcagcgaaaacaaacacgatggcatgcatgtgtgcgctaaaaaaaataacgaatctgcaggtcctgaacagggtaaccatgcacacacagacatcacttggcttttttttttttgccacccttgattgatccaagctgtctgatgtatatagaatgatatgtgcgaccggtacgacacttcaaaaagtcatgcataagccgaccatgtgccctcaggagtagcattcgagggtgccaacatgcatcattgatttgcaacgccgtattcaggtacctgccattcgcctatccacgcctgtcggcacaccccgctctcacctggaataggacgccccagtccttgtgaaggactagtatctgtgaagccttgattccaaatgtctagaacaacgatcaaaatatcaaccatgcaaggttcgggctgcggagaaaggcagcagatgcatgagtgacttgagcagcgaatgtactcatttcagtacacacgaaatcatgctccgccgattatactgaaaagaatttgagggcatacgtggcaagcgacgaccgacgactcgggacctcatcaacttcatgcaggttctagccagggtattcaaccacatggtgatgaagaggagctggtatgaggaatatgccgcaagtccctctcgccccaccaagtacggtagggcatttttatagtcccatatttcgtgcatgccatgtggcgctccactcgctcagctgcatgctaaccacaacatagcgtcagcgctttaaagcgggaggaaagaagtgggcgtacagcaaacaaagtgtcaaacgtctcggacagcgcacggaagcaaattgtgaccctgtcagggttcctgttgatgcctgaacaagtatcttcagccgcagcaaagtcaaacctacgcctttgaattatgcgaggtccgaaactacaagcgtatcagacctgacccacaagaccggcttaaacgatagggtccctgttatgaaagctacagcaggtcatgatcgttaatcccttcaccttcatgtccagcgccaaccaactcccctataaagcgtcagcactatgctggaccagacatgatatagtggccctcagagatcgaagaatcttctcactatctactcgagactgttgtttagcgtccttgatggattgcgatgtcaggtgtagtggctccatgctgcgaacgactcgagacgcgggaacattctcacttcttgccttcgtgctcggccacgaactgaaaagcgcgagcggtttcgcgcaactcgggctgagttttctctcatgagcagcatgcaaacttggccaatttttgagaccgtctcacccatcccttcttaaaagacatgggctttgaagtcagaaccctggtagagatcggatgagcatagagcgaggtgctgatcttgtggcgcagactgctgctaacaatatccgagtgcttgggcgggggctggaaagttgtaaagcaaccaaaggaaacgaaaaccgcgttaggcttttccctcgttcgaagaaataggactgactgcggtaaatgcaagatagctttccttgtgccgcattcatgaactgaactgaggtgaacctgaagtggacaccgtacctgcttttccttcactccgaggccaaaagtgtgctgtgagcggtcaccgagactttgagttccttcagccaatgcacatttcctgggcaagagttctcagagcctcatgccatgactcgcctgtcgttggagcgctataaaagacgcctcgtcgtcgtctctacatgtccacaagtcccctcagttcaatcagccatttccaaacaccaccacgaccaatacgactggccccgtacatttctgtttattcactttcgcccatccttcaaccttcgtttctccaccatgcgcttcaagcatcttggaaacgtccgggtccaggcgccgctcctagtcttcttcgcgctgtttgcggcgcaagtcgctagccgtgccgtctcgtcttcaagagacgccagcacctcatcccacgcgttaaaatctacgcgagcaatagggtggaaagagcctgatgcaaaaaataacatcatccccaacttctcccgcgttggttacagacaaggccatatccagataccgacggtgcctgtcgaggcaaccctgaagcgatacagctaggatccaggaagccattgacagagtcgggaatatgcccctaaagtcttttggcagggatgtgatcatgatcaggggcgcggtcctgttgaagaaggggacctacagagtcgcaggagcactgatcatcaacaagtctggagtcgtgttgagaggtgagggtcaggatagcaacggaaccgtgattattgccacggggaagatccagcgcgatttcatgttggtcaatggtatgttgtcctctagcatgggatccgaagcgaagcagaaggaaaaggccagaaccagagacatgatgccgagaaatgggtacaaatcaagcaacaaagcggagacccgcgctcgtaagggtgtttacatcccagttggaacaacgactattcaagtggacgatgtcaccggtttttacatccatgacaagattggggtaagtgatttctcctcaaccagcgcaaacaaaaaggcgtgaagggtgagatcaaggacaaattgtagtgtaataactttgctaatgcatgcaaacctcgttagattgaacggcttggtgatgagaaatggatcgcagatatagggatggacaaactgccgccgcgcccggacacaacaaaagcttctacgcagtggacacccaagtcttacacattccgctttgaacgaacgatcgttggagttgatcgtgccaatcgcgctctcatagtcgatataccgatggtgatgaactttgatccaaagtacgaacgagcaaagatctatcatctcgttcacaaaactccactgatttcggacgctggtgtcgagaacctgcatcttgtgagcgcatataactccaaggatccggaggacgagatgcacggttggtacggtgtggtggtcgacaacgcgatcaatggctgggtggcgaatgtaacaaccaagcactttgtcagcggtatctttgcctcgatctggtccagattcatcaccgttcaagattgcgccgtgctggaccccatttcgaaaccttcatcaggcgggcgtcgataccagttcaacctcagtggtcaaatgggccttgacaaacgctgccatacaaaccatgggcgccatgacttcatcacgcaggggcgagtgtgcggtaacacgccaagatccaccttcatgtctttgaatagcgcatgatcagaaggcgagaaatgcacagtactgatcctctttttttctgactttttttattcgccaggtccaaatgtttttgtcgactccgagggcgaccaagcaaacaacgattcagggccacacgagcggtgggccacgggtgttctttatgacaatatcgcctccaacaaaatcattataggaaatcgaagctggtctggttcaggccaaggctgggctggtaagctatatctcctcctcaaccccattgttcgtttgtatgggtaccttgctcagcattttgacatcagcttcactacatgcgtatgaaacgcaggtgcattccatgtcttttacaattgtaaagggcagggcaagggcagctactttcaagatgccccgggcaccataaactgggtctttggattcaagggcaaccgtgcgactaagcctaaattcgaaggtgtaaccccttccaaactaatttcgcctgacaatcatgttcaacctcgcagcctttattggtcgcagctcgctgaacgcacaggaaagagcgccagtgcgttgatgaagatgtagcgaagtgaagtccgagagtggcggcttccaggttgtgctttagagcttcggactttttaggcacaaagccgacgcatttcagagtacaatatttgcaacaagaataaacgctcacgtttttacattcaaccggaggttagggtgattgagcagcaaacaagtcatgccaaacaagttgcaagagtcgatcaggaaaattcctaacgcgtaagaatgaggttctcgtattgatatatatcaaaaaactgggttttgagccctccagtggatgtgttgcaggcccaacttgtcgcacttcacaagtgaagcacctcgacagtcaaaatgtctttgagaatctgttccacactttttgacacagaaaaatgggatggttaaaactgtcccacccgcccatgcatgggcatgaactttgatccaaagtacggtcaaggaaggatatatcaccttttttacaactctaccatgatctcggatgtgggtgtcgaaaacctttgtcttctgggtaacatggatttgataagtcacgagactaaggtgcctgcggtggaaatcgacaatcgatccacggttgggtgagtgatgtctccattggatcgttcacgaatggtatccaggcttccagttggtcaagattcgtcacgatccggaactgcgacgtctctggtcaaaatggatgccaaatgggtctcgtcaacaactgcagcgcgcatgtcagtggccgagattttactactgaattgtcagcctgcggtaggacgctaaaagtctcttgcatgccttggcgctgtcacacgttcaaacgaaacaaaacgcagatgagaaaacacagatcgctcattcattcccggtggtgctacccatactctaggtccaaacgttttcgtcatgtattatggcagaaccatcgtctcaacaggcccaagtgggcagtgggacatgggagtgttgtatgacaatatttccagctttttgtttgaattgatttgccgcttcaaccatcctagacgcggatggacgggtacgtttaactcttcctccgcacatcgtaagcccgctccttcacaggctcgtcccataagctgctttccacctcacattatgtatgacccaatctaggtgccttccatgtcttttacaattgcatggcaagatcgcagttgcataagagcttcatcgaaagcgcacccgagacgacaaattgggtcgttggattcaaaggacaccttacaacgaggaatatttcgtcagcgggttccataatcaacagaaactacaccgagactgctcaacctcgaagtctttattggtcacaactagctgcccgcagaggcaagagcgtggccgaaatgatggctctgaacggaccgagtaaaagaaagtatcaaactttgcgcacgcgcctcgcgcgtgcttgcagaagtcttcactaataaacctagcggcctctacacaagcttgcctatcagaagacattcaatcttttggccgacagtaacgccagacatctctgctgttcgtcctgggagaaccatcaagctgttggcgccaagcatcgtcaccatgcgactgctcatctggttcttatctgttgactgaacttgtatgcggccttcaggcgtcacagagacgatggcgcgttggtattcgggtcgttcatccagacgaacgtcgtgtgtaacctatgcagaagaggttgagatgttagctgttgtagaggaagcaaaagacgagaatggccccgagtagttttgaataacccaagacgactgtacctctgcattgatgcttggccacatgtacttttcgtacccagccagcttgcgcagagcgggcaagacaaagaggtggaacgtgacagttgcggaaacaggattgccgggtagaccgaacatgagtttcggttgtgcgccaccgtcggggtcaggaatcgtggcgaacgtcgtcggttttctagtaatcatgagcaatggtatcagccagatgtaggcatcataactgatcgcaatgccttgcaaactcaccctggcttcatcatgatgcggccgaaatgaatggtggctccaagcttttgttcgaggatgggcttgaggagatccatttcacccatggagacacctcctgtagtcaccacaatatcgcatttttgaagaccgctcttcactgccgactctagagcctcggggctgcatcgaatagttaataaataaagtcacagatcagtaattgaggcgcggagggtcaaaacgacgtagggcatgcggaggtagttgatttgttatacctgtcaggtgcgatgcccaagtccaggtagtcaaatccagcggtctttgttgcagcgataagggtcggtctgttgctgtcacggatctggcccatcttcaacggctctccattgtcgtggttgaccacttcgtttccggtcgacaagaatccgacaacgggtcgctgacgcacacgcacagtatggacgccgatagaggccaaaacgccaatctcaccaccaacggcagaaatgacctgacccttcttgagaactgtttggccaacctgtacatctgagccgatctctcgaatagcctcgccattccgcaccttggccagaatctttacaacctcttcgcgtgttccgtcgtcggacgatttgatgagctgagtgtcctcgaccatgacaacggcggtagcaccctctggtacagctcctccggtggtaattctggcaatgtgccctggaagcaactttgctgatgatccttctgatactgcgctggcgatggaaacagcagtgactgggtactctccagggccatcggtatctgttgttttagaggtagaatgcagatagaaacggattacctttcatcagaaaaggaatacaagtaacagtatgttgtatcaaagtgccgaatacatccacgttcgtctgtccctcatttaccgatgacagcatatccatcaagaattgaggcgcgatatccaggaacagcctccacggctacaacatcctcgtccagtacagcgccgatcaactccgcatttacgggtttctccacggaaggcaagggggcgacttgatccataaccgaagccagtgctcgatccattgggatcaaaggatagggtgacttgcggagcctacgcgaaactgatgcatccaccatcgagccgttagatcattgctcttgacataatagggcgtcgttcaactccatataacggccgcatgtggcgatacctggtgtctctaagctgagagatgacgcatcagatcgagtctctctgtcgctatgatgaaagcaggtgtgaccgccgtgcccatgaccatgtccatgctcgtgtttatgcatgtcatcagtccgcggtttctcctcgctgtcctttgctacagccccagatggccgaggtcctccttgcatcatctcgtggaccttttttcctgtatccccacgggccaggtcgatggcatgtggcaaaattttggccacggcttcgaagttttccttgacggcctttggacttccaggaaaggtcagtacaaatgtctgaccgcgaattccagatactgctctgctgagggccgcaaagggcgtgatctggatggactttgagaagatgaggtggctgaccccaggcgtttgtctgtcgaggagtggcagcacagcctgcgagccagcaaggcgttgcgacggtgcgttagcgttcatctagtagactagtaaaccgagcaagaaggatgccttcttatttttacctctggtgtacagtcgcggacgccgaatcctgtcccgcccgtggagacgattaggtgcaggtccagttcatcacaccaagcagtgaccgtcctctggataaccttgaagtcgtctgggacgcatgccttcacctgcactttgtagcgcggctctgcctccagcagacggcagagagacgggccacttgtgtcggaaacggggtccaacgacgctgtgtcgctgactagccagggcaagacgagtagacgggctgtgcgttagtgaatagcgcagctgaaggccgggggctcggagaatttgctggcgagggtggagcgccagcaaagagcctgcgcacgacttactcgtaaggacaccgacgcgaatttcagttgccatgtgcgagtgtctgtgtgggaatgagagaatgaatgagtgagagattgaatgagggagtgctggatgcgtcgagtcgaggtcggaggactgagcagattccacagtcggttaacgcggggaattggaggtgagcagcaatggggcggggtcaaggtgggtgcagctggggaactggggaacgcggaaagtttgaccggtagaaagggcccgtaagagggcggtggctgacgggcatatcttcatgtgttcatctctttcaactgaaccaccttgaccttcgctgcctcatgtactctacagcggactatacttgcttggcctggatcagccatccacacgaccatagcggccatgcggccatgcaggcagctaggctggatttggaccaccaacgagggcacgggcgacagggtccagagacgatgctggatctcaggaggcaaaggacgcgacgttggacgttgtcaaaagccgcggtcaggacactcgagtgctaacgggtgcagacgcgccgagtctggccgagcatctctgagtgaccgcgccacatgcagaccaaggtgaccccctggttataatatacaacgtacaccgctccactgtcgatgtgattttctgctgtgcccctgatgttgagactacagataacggtcgagaattatgacctcattttacatttgaaagaccactcttcctccgaggtcttctttttcgctctctcactcactctcacttggttgacataccgccacgtatcccactctccacacagccagacactcctcagcacgtttcgccaacacctctctcgtcaatcagccttgccaccatgagcattgagcagttcagccggcgtgcaggctacatcattgcgcacagaatgaggggtaatgttccttctggacaccgaccggccctcactgcattccttcacacaatgtggagcagagttaacgctgtcttttgcgtcctcgtggctatcgttcatcttgtcacacatatggtcctctcgtatccggctatagagttcctgcacgagaacaatcggcctgtccagccagcccagcagtcgtttccttcccaaactgccgcccaccaggccatggtggcatcgcagtaccctggccaccagcagcaataccagcaacaacagcagtattatcatcaacaacagccacagcaacagcaacagcagcagtaccagccacagcaacagcaacagcagcagtaccagccacagccacagcaacagcagcagtaccagtaccagcagcagcaccaacagcagcaacagtaagtagacacctcttagacaagcggtagtagggcttcctagaaaagggatactgaaacctgactctgctctttatttctaggacttttaacatgccatcaccacctcctccctatgaagaggcgtctagcatggattgcacccgacccagctggatgttgcctgacgcctcgggcaattgtataccagacttctcaagggtcggctatagagaaggtcatgtcagaattcccttcgtgcctgtcgagattgttttggagccatcgaatggcacgtgtgtggacgacacagcccgaatccaagccgccatcgacactgtcggaagactgccgttgcgcccagtaggagatgacggagctcagatcaggggcacagttctgcttcgagcgggcgtttatcgagtcgctggagcgttgatcatcaacgcctcgggcgttgttttgagaggtgagggtcaggacagaaacgggaccgtaatcatcgccacaggcaagatacaacgagactttatcctgatcaacggcatgctccagtcggaaatggggtccgaagagctgcagcgtgccaaggcaaagtccagcgaaatgatgcctagaaatggttataaaggcagtggtggccggcctgaaacatatactcaacagggtgtttacatcccagttgggtccgtcaagatccctgtactcgatactaccaagtataacgtgggcgatcccattgtggtaagttcaagtacttcctgagcgaaacatgggaagcacacgcatacccaaaagacgcaacctcacaccgtttccgcttctgtcaacagattgagcggcctggctgcgacgaatggatcagggacatagagatggatcgtctgccaccacgtccagacacaggggcaacttctacgcagtggacgccaaagtcatttacatttcgattcgagcggagaatcgttgctattgatcaagcaacacgcacgttcacgatcgatatcccgatggtgatgaatctcgatccaaagtaccctccagcgcggatatatcaccttattcacaaatacccaatgatttccgacgttggtctcgaaaacgtgcgtcttgtcagcgaatatgatcctaaaaaccatgaggatgagcagcacggttggtatgcagtggtggtagataacacgattcatggctgggtggcggatgtcaccaccgagcactttgtcagcggtatcttcgcctcgatctggtccagattcatcaccattcaagattgtgccgttctggacccagtctccaaaccatccgacggcgggcgtcgataccagtttaacctcagtggtcaaatgggtctagtcaagcgctgcttcacgaacaaggctcgtcatgatttcatcacgcttgggcgcgtttgcggtaaggtggctggtgtcttgatttgcgacattgagtaacgaatggctcacgttgcccggacttaatcgagtttttggttgtgcttggatataggtccaaacgtctttgttgattcaactggagtcgacggcaacaacgatacaggacctcatgagcgctgggccatgggaatattatacgacaacattcaggccaactccatcaacatccgagagcgaagttggatgggctcaggccaaggttggggaggtaagctttgtagcaatgtcgttcgagccgattcggggagaggggtttcggtgcctgatactgacgcatcgcgcctctactttaggtgtcttccatgttgtgttcaattgcaaggccaaaaatagctgctgctttcaagacgccccaggcacatgcaattggattatcggtttccagggtcgccggtcaggtagacccgttgtcaacgccccgctttcctctacgcaacttgacgaccagcctgttgaacctcgaagcctgtactggtcgcaactggttactcgaatgggcggcgatattgaactagtcaagaggaacgttggcgcacaggcccgactgcatccacctcagtagtgcccctgagctacgggtagatcattgatcaattcagcgttataaacatgaaatatcttccatgcacgtggttgtttttgtcattgatgtatttgttgaaaacgtttgaattcgtctgatctatttgtcttctttctccttgtgggcttgaagctctttggacagagctgcggcgccactggggccagctgcagcaagcatctctgaaacgaccgccttgagctcatcatcgcgatcgacgccgtcgttctcagtggccttcatgatcgattctatcctctctttgtatgccgagtccttctcgttgtcatcgtgttcgtcgtcctcgtcctcgtccttgtcctccatcaaatgcgacatgtcctcttccaaatcatccgtgctgttgtcagggtgaggaactccggtcagttcgcgcagataatgagcgacttcaaaccattcttcctcctccgcgttctcggcagcctgtgagatcacccattgagattgcttttgttagatatgtcattcgcgccgacgtatacgctacatggggtgagagtaagctttggaagaaacaagcgccgacgatgctgcagcatagagatcttacagtcatttcgttctcgttgacgtgggtggcgtcggctccagccttgacaagcatctctgcaatctcgacggtctcgcacacaaagagaggcgagtctccctctggatcctggatgttgacgttggcaccattttcgagcaggtgcttgatcaaatctttgtgtccatacgatgctgcggcatgcctggtcagattgggagagaaggagagaaagagcggcttgagtgtgagactgcgcccgacctgcatgctgaagaaaaaaatcatcacaactgcggatagggcagcaagatgcggcggcttacagtgccgagtatccgaattcgtcctgtgcgttgatagacacgcccttctcctcgatgaatgtcttgacggcggcaaggtctccgtcacctaaagggcaagggagcggaaaaaaggagcgattccgaggtcaggtcaaagtcgcctcgacagccagttgcagtcgatgcctgtcctggctgaggaactggtcttttgctcttgttctccaggggttcctacttgctgccaaccagatgttgtgggacatgtcgagggaatggaaagagggggggacagtggtgtggcgacggatgaggcgatctttttcagcaaacgaatgcaaaacgttcgctcggtcccacgcagccagcaaggtcgagtggcctgtggcgcagaactgatcgcgatcgcgtgtgtaaactgactgttcgccagcagtgcagtgctgctgagcttgtttttgtgcttttgctttcacccctccctcgcgctcctactcaggcctgacaccatccatcgccaccaactgcacgcaaccccttcccttcacgctcttgtctggcgatcgggtgctcgttccttctctgtcagtctgattgtccgttggtctgttcatcctctctttcgttttcccgtcctcccttcctcctcctttcctccttttcttcttcgttccgtgcctcgctcgcgatcactgctgacaacaacgacccacgactcgacatgttcgctgccaaagcaccccatgcgaacgcggctggcaagcagcagccacagaggcccaagccgtctctggataccagagcctcagcaggcaccatcgccacgcaccacgctccaggatcagcactgacgcgggaaaaatcctttgccagcaccatttccttggactcggaatcctcgtggacgcccatgcaggaggacacttcacacggcgagcagacgcgtcccctgcccggattcactggcagcggcgccattgatgaggattcgatctactccaagaatgagcgcaccatggttgcttatttcgggccattgccccgggaagtcgaggatgctctggataaaacaggtatggtaccctgttcctgattgacagagaacgtgttatcctggccattccatatctatatacagcgttgctgattcacgcctctctgactgacgcctctgatagacttttacacccagcccatgacagccaaagtcgacctcgatgcaggcctcgggatggttgtctcccaagaaaaatgttacatctgggccgttcagaaggtaggttgtttgatcggttttctttttagatgggaagacacgagctgttgtttcacgagatgcccgacgagcctctgtgctcacgaaggattcttggacatagaacaccacatatcgagctgcgcctgtttgctacacgttgccgatgccgccgtgcagctccaagtctgttgaagcctctgtgctgttgcctgtggtcaccattactcgatcggacgatgagactgtaggcattctcgcctgttctccagatggtctttgctggtactggaacaatatcgacctctgcttttcgaacgcggaccagcatgtggacacaagaatcggcatcgctcagggagactttgtgacccatgtcgagtgtgcaggggtgagtcctcagaaagcttcgttactgtatgtcgacaaatcgtaaagcgcctttacctaaaccagaaatgcttgtctgaatctatgcaaacagcttatgggatattactttggaacaaagtacgccaatgtataccaggttgccgtcaagaaacatcttggaacgaccgttttggcttcagcacagctgcctggaaagggcggaagcgccattacgtctatcttcaacttgattggcgtggcgcaaggaccagacaccactcaaaagattgcgtcaatgacttcaggacctaaacctcaggactttcatggacgttgggacgtgtttgcaatgaccaggagatctctcttcaaatggcacgtgtatcgatcgggcgaatatgcccttgaatgcgaatacccactcaaggaacaactgaccgaacggattcatcgggattattcagccaccatgcccttcggaaacgacccgcgtgtgagattgttggacattgagtatatcaagggcggaaagttgctggtgctggcaacgttctttgatacagcccttagaacagccaccaccccactttcatgtggcctcttcacactgttgccacagatgcagtccgctgcaccctttgagatcgagagtgtgaagtacattcagcgcacaatagtaagtctttatgcatggatttgaaggtcaactgaaagatatgacagctgtcaatatgtcattgctcacataccgcgttgtggtatttgtaggaggaggatctccgtccagaggcatctccaaggctggtggtaccccgaggtgggcctggagttttcatcgtgatgcccaaggctgtgatcatcagctcgacattgccggactttgaattcgaagatcttgttcctctcaaaactgacaggatcatcggctttggacacgaggactggaaacagcgcggacaggaaatggatggtgccagcgagttacccattgtatgcaggagaagcggtcgtttaggcattcatatccaactggagggcaacggatatctgtcgtcgtcgtctacaaagatgggcaaagagctgttgacagctcaactgcaggccaaactggagcaggcagtgttcttcagcggcaagagaaataaccccatctcgttcgacctctctcattatgatggaggggatctgaatgaagcctcgctaaatgtgagccaggagatcttgaactcacacgcgggcttgttgaactctggcaaggatcttactagtcggctgtcagagcgttatgagaggatcaggagtatcatcgagtgcattcaagcggcggatatggcaagtcgactctccatcgatgcccggtttcagctttgctggagtgcagagaaactggctgcggcaaatgcgctatggaagcaatatcagctgagggtggcgtcaaaggacagtgccaaggcatcaaaggcaaacatcaagcaagtcattcatgaagctgctggccacgccttgcaaaagattggcgtgcacaccaaagaggatcccattacattcctcatgatctacagagtaagtggagatgtagaaggaattattttttatactgtggccgcaaccatttactctgtacttatcacacatctcgatattcgttgatttaccattaggtggacgctctgtcggagcttctctgcagcctgcacctctctgcgctcaaactgaacgctgcgcccgcagggcagcaggcacagctgacgaaagacatcaacaggatcatcgtgttgagtttacgctctgcttggaattacaggagacagagtgtggacagctacgccctggagggtagttgcggcgtcgagccatggacaggttggtgtgctatttttttttcgtccttcatgtgacggtagcattgctatggaagtgcacatatttatcaagcgcgcccttccgatctctttttggtatagcaaccgagagtgtgattaacgccctgactactcaatacaagcgcacgcttgagcactgcactgggaacgaaatggacgtggataatcatgatggattggatgcagtcgcagatctcacaatggagctcaaggaccagctctgcgaccttgccgacgtcacgctacaggcccattctgagcgacttcagtatcttgaagggtaggaacgaagcagttcgacattatatcggactgttagaaactgctgcagccgaactaatttcgataccgttgatccaatgtcagcctgccatcttctagcaattataacgtcaagatcgcagcagccgtggttgcctatgatgcggccaaaattaacctcttgacaccattaggtatggcagagtgtaatgtcttcatgcaagggttgtgctatgaatgctgggcggtgtgactgacgcattctctctttgctattccagtcgatctgaagaagatccagcctgccattcagctcgcacaacgatacaaggacttcacgacactggtgaagctctgcatcaatgaagaggacctgatcgccagctatgtcgacaaatatcagcaagagtttgccaatgctctcttccggtggtatatcgataacagtatgtgaaccctccaactgggaaactgtctggattagcaccaaagaatgcaccactgatgcccgccgaatccaaattttcttattttcgtccccctgaaacgtgatagatcaaatggccacgcttttggaggtgggcgaaaagtacagtgacctctttacggtcttcctggacagccatgactacagcgagatggcttggctgcatgacatcaaaatcaatcgttttatcgaggcttcgcagcgtgtgcaagaatgtgcttttctcgagaacagcattgatgggcgcaaaatcatgttcagcttgagcaagctcctattcctcgcgggactacccaaggaggatctggacgcggaggccgctgagaagtatggcagtagaaacaacgaggaacttgagatggccaccattcaagcgcttactgcagatgcatgggagaagaacctgactggagcgatgaccaacattgatgacaagaccaaggctgtgatcaagaactttggatcccagcttttgaagtcgcaaacggtcctgcgcgaggtaagcatattctcagtgatagttgacttggaatccgctgtccatattacatttttgatctaactgaatgaatttgatctccaggcgattctaaagtccacagcgtcactgttgcagcgtcagaccatcagctcggaggatcttcttgaccttttaattcttcaacaggaacgtgagattgagggtatcgatgtggtggatgcgtctctcggtatctgtctgaacgctgccgacatcccagaaagccgcagaccctatgtcctgcaggatatctggcgcagaatctacattgcggaaactcgggaggaggcggattggaatctagaggatgtcagtgacctcgaggcgagggagaggctgctccagacatggatgtgcagggcttatgctgtgatttaccgtgcagaaggacaaaaggacgaattgttgctgcgaccggagcaagccaagtgtaacatgcctgaggacctgttcaagcagcggtttatgagctcgggtgagcgcacagaaaagaccaagggcacggaaaccaagtacaagtctatgatcaaggattatgagcgggagaacgccgagctcgagaggcggatgcgggagggccagcttcttcagaaactggagcgtatcaaggagattgtcaaagaagaggctgcgaacaccgctcgtgggtctgcgccaaatggccatgagacattgatgcaagatgtcgagatgcaggaggacctctaggatggcacaagggaagataggattgaccgtagacaacccaaaaaaaaattgtcgcaggcttttattgttcgctcttcgttgccgcaaaagggtatggtacaaggatatggagggtgggtatccgctctaacgtcttctagtcctagactgttgggcttcgctctgccaccggtactcgcgcaactcttttgacaaatctggcatctcggtgccccatgcaggcaaccttaccacctagatcaggagggatacagcaagagatattcgtgagcaaagagtgcctattttgttttttgtgcagcccccctgtgcagggtagtgtatacaatctgagcatattcaacacacaaaatcgcagcttaccatcaccgtgcaattgtcctctgcgccaagttgctctgcaaggttcaaaagattggcggcagcctgcgtcgggttgtcttctagcttgacacagtcgaccacctcttggttactcatcacactggtgatgccatccgacatgaggactaagaatgcagcctccttggccttgacggtcctgcgaacgatctcgggctctgcagacactccaaagggcttcatcgctatatcacccaaagcgcgggtgttggccaactgtcccaggaacatgttttcgccaaacgagtctgcagtaacgtaggcagccatcttgcggatgcgatctacgtgaccggagcgagacaaaagaggaatagaaaacctgcacgtataagggcttgccatcgtatctcaagacagttcgaaaccatgttcacgcttgacacaaaaagcaaacagatgagaggtgggggagacaggacttgtccgttttcaatgaaaggaagtgagagtgcgtacctgcttcgaccacagcatccggatggtgatcagtggtcaattggatgctctcgccccgaggcgcctcacagagcaagacccgcgtatcgcccacatgtcccaagatcaagtccaggtcttcttgtgtctcccagaaggcgcctttggactgtacaatgacaacggaggcggtcgagccatcgcggtatttttcacggatgagatccgtgtcacatttcaggaacgagaagcacagccgctgctcgagtgtcatggtcgccggaatcaccttctcgggttcctgcgaggatctcttttgagcagcggcctcggtgtcgttatcattaccctgcaacatcgtgagctgctcgtactctgcccggtctgtgccaaagtacgaggtggttcctccaggcagaggcgaggtcttgtttagatgcctccttctcgcaatcacatatggatcttcatcctcgtcatatctctcgtccttgtcctcgccgccgctctgatcttttccgtgcctgtcccctccctctatgcccgtcctggagttctgggttcctgccctggcagctgttgtctcagacagaggcttgttttcttggcgagtttgctgatcccgatagttttcaacaaccttgtgatcacccttatcaccaccaccgctttgaagtgatttcaacgtctggtcctgttcttcttccgttgcattcggatgggggatgaaaatcatgggcttgacctgcccaccctttcctttgatctgtactcgacgctgttgctgctgctggttcttggccctttccgtggccggattcctggctccataacgttcctcaaaatccgctggcagaaacggttccagaaaatggggccggaacgatcgaaagtaacctccgagtttccgaagatctcgaatcaccggtggaaccatctcggggttggcggtctcgatatactcgtccagattggccgtcagataatcggccgtgtgcgaccctccgtggccatcaaagatggagaaataaaaaagcgtcttttggtccgcatccatctgagttccctctgtgcttttgccgttactgttgttaccgttgctttcgttcttggcagccgacgctgctggaggtccagaagtagaagatgaagtggcctgttctaaagaggcgagttctggtgaaagtgtgggtgggttcagaaccaggaccttgtaccggtcctcgttgtatttccgttgacagcgtgtggatcggatgccgacaaagtcccgcgatttggcaagatgaatgcggagtgtgtcgccctgagagttcttcatggcaaagtaaggctgtgcatagcgcggtgcggaagccgaagtaaaggagcgcgatgactggagcagattggtgtggagccggtggtcgggtaccttcagagctgatcccagacgagctgatgatacgcgtccgcgtcctccattatgcaataagcacgtgttgctgccgctgaacaaggtcgagccggtagacagcgccgagggagcggatctggcgcgagaaagtgcgtgtcgtgggaatatcgatggagcgataagacgaagggactggtcggagtgtggaattgaagagagccgcatggtgaacacaatggctgaggacgaaacctgcgtttgttgggacgcaaggttcgcagggggaagggtcctgggccgtgggcaggttcccgctgtcgccagcgtgcgtggactacagtgctggatgcctgatatgtctcctgaagggcaagcaagggaggtgcgggcacgacgaccatgagtgtgacgaatgagtgtgtttgctgaaggacagttggcgagacctgttgtccaggtgatgcggttgaggatggcgggtcgagatggccgggtccctgcaaggaagtagaccattgcgccaggtctgtctaatgctgcggtgtgcggctgctgatctatggttcccgttgctgtcggctcctgcgtggttgcatccgcgcgcggatgtcgagaatggggaagaggtgtgcgaaaaaaaaaaaagtttggctttgatgacgctcactactgtacaaaccattttgtgggacttgataactgacgtgaccgtacttcgccccctgccgcggtcttactacgcgtatccctttggcacgacagacccaaaagcaggtcaatcacacatgtaatcgatctcagtggagtcctggcgcctccctcctggcatggtcgctcacatggacaaaaagtccctttctttgaatcccttcgattttcccttcttttttttgacgtctgcttggtgcccttttttcttggagccaacttctttccaggtttcaacctcgcctttcgcctcgttccttccgttttctggttccccattccccctctgcaacctaagcacttccataagcttacctgcttctttcccactgccttactttccgccaacctaattcgctctagtgccttatcctcatcgccttcactactttcgcttcaaaacgcccttccccttccttcagcggacacactatcgttctgttcaacagctagcacctcgtcaactctacaactctacaaatctctcaccatgaaggcattggcggaaacaaagaactctgcatcattcgagctcgtcgcgattgatgaccgagccaccagtgcggccccagcaacgccagagagagcttcctcagaaacaatagcggcagcgccgcccaaagagaaaaaggatctctttcacatctcgccgagaggccgtttggtggcccttgctggatatctgttggtaacagcatggacctaaatttatccaagcaaattcgggaatgcccccctctctttcttcaattatttaacgccctcaatcaccgctgttgaatggtcatgcgatagatcaatggactttcaagcctttacttttgtcttgtccaagccggtatggaaagcatagagatatgttattccttcggaagctgtttattctactcaacccagggatggccagccctgggacagcagagcatcgacctggtagcaatgtcgtacatctctggcacggtctctgtatttggagggacgcttggagcgtttggcatgtatgccgcctacaaggtaaggaacatgaacatcattttcaatgcctctaatctcctgcttctcctctgattatcagttggagaggagtgaggtagcattcactgtaaaggcggcgagagaacgaatgagagagaaaaaaaaacgaaagtgtggcgagttaaggacaggagacaggcggacgagcacctccttgatacgataattcccctcctcctcactttttttttaaactcgtggatgtataaatatccagcagtagccgattcaggccaacgtgccttgttactttcagtccctttctcatgggaggaaggaaagaaatcacacccgccgacccacaaaaaaaaaaattgctccttggcggaaaggagcggctaaatcggcaaactgttaggacccttcgtccccgttgtttcctcctttccaaatgcctaaccccttatcttgcattctccattctgcaacttgtaggagtcatcctccaaagtcagactgttcgctagggcatggtggatgatgattggaatcattatcggatcgactgtcctcacccttttcctgaccgtcatccataaggagcggtttctgaaccaatgtggagccgagcacgatgatgtttttggcaccgcagagtgtggttccatgtatgtgggagcacttgttggatcccttattggatgcttgataggcgtcaccatgattgtaagtacccgcaaaagaacaaggaaaccggacgcattcaactgccaacccgcgttctctgtcgacaatacactaaactatccttttgttcatttgtttttcatttgttcattgatagtggtgttatggtgaggacgtggtcaattactcaatccagcttgaagcggtcgaggacaagacgcgtcgccttgaagacagtccttgaagcaggcatagcgtatcatagacaattttaatgtaccatgaatgaacgcgaactgaagtgaaacagggtctgagcacgcgagaagacttttttcactttggtccgtgcgtcattcgcacctcactcgctctttcccacgaattcaaattgaatttcattcctcaccattcccactctaattcaccaagcgccatgtctgagaagaagaagcatctttacactgtggttggtaagagcggctatgctgggtctggttagggtggactgtgtggtcacactggacaaccttctgacagactgcatcgtcggtgtcagtactacgggtgaaaaaggtgcaactgggagtgttctaccatctgacaatgcctcaaacgcatgctgttccctacctctttcaaataaaaaaaaagtgctcggtgcatcgggagacctagccaagaagaaaaccttcccggcgctctttggactcttcaaaaaccaatatctggatcaaaacacgcacatcgtcggctatgcgcgtacaaagatggatcggcccaagtttgaggagcacatctcaaaacacatcaaactcaagacccaagacgacaagcaggcactcgcccgctttctcaaacaatgttcttacctcgacggacagtatgacacagacgacggctttcaagcgctcgaaaagtcacttgtggatattgaaaagtcctcgcaggccaccgcacggctgttctacatggccttgcctccctcagtgtttattccagtagccacgaacctcaagaagcacaactacaaaaaggacgcgctcattcggctgatcgtcgaaaagccctttggaatggatctcgagagctcgcgcaaattggccaaagatctaggcgccctcttcaccgaggaagaggtatctgagcggaaaagaagagacccatgctaagtgacgatcattaaccactgaaggaccgggctaacatggacagtacctatattgaactgttgaccgttgatagatttatcgcatcgaccactacctgggcaaggagatggtcaaaaatttgatggtcctccgcttcgccaatgtcatcttcggttccgtatggaatcggcattgcatcgataatgttcaaatcacttttaaggaaaagattggcactgagggcagaggcggttactttgacgagtttggtatccttcgcgacgttatgcaaaaccgtaaggctcttctaacttatcttgcatatgtactagcgaatacgctgaacaggacaaaaaaaaaaaggtcgttcaatacactaatgctgaggtggtatgtctctatctcagacttgctgcagattcttacgctgatgacgatggaagcccccatcacgttgggcgccgaggatgtgcgggacgaaaaggtaagactacggatactcattccaagataaaatgaacgcggtcgatatcttgcctgacaccggttcattgaaacatccttcgcctcaataggtcaaagtcctccgcttcatcccacccatcgcgaaggaggatgttttattaggccagtacaccaagagtgaagacggcaaggagcccggctatctcgatgacaagacagttcccaagggtagtaagaccccgacttatgcggccgccacgctctacatccataacgagcgctggtccggtgtgcccttcatcctcaaatgtggcaaagccctcgaccagcaaaagaccgagatccgtatccagttcaaggacgtctctggaaacctgctctcgaagctgtccaggaacgagatcgttatccgggtccagcccaaggaggccgtctatgtcaagatcatgaacaaggagccaggcttgggtatgaagaccgtcatctctgaccttgacctctcgtactcgagccgattcgacagctctgtcatccctgaggcctacgagtctttgatcttggactctttgaacggagatcactccaacttcgtccgtgacgatgaactggacgcggcctggaagatcttcacgcccattctcaagacgatcgacaatggtgaaattgtgccggttccttatgcgtttggaagccgaggtcccaagggcgtgacagagttcgtggccaagcacggctatatgcgtggagagcaagattacgtctggccgcagcattctgaggccggtgccaacgccaaggggcaagagcagaaggtggcgaaggaccagcaaaaggacacaaggactgaccattaattgatcaaaccatgctgcagattgacaacctaggtctcgcccgcatggaaatggaaggaactgggggaggggggttgcttgtatgggattgtgctctttttattccgggaggaagaaaggtctagatgctcattaaagataaagcgagagtgtttactcgtcatcctcctcggcatcatcgcccttggaggcagcggcagcagcgcgctttctcttgacacggccagcacgtccaccaccgtagggggaggtaagggagaagtcaatgtgcttctgggagtcgagacggacaacgaaggaggggatgtcaacgacctgcttgccgacgcggatgtggcgctgacggatcaagacacgggcgtggtggatagacttggcaagacccaacttgaagacctgggtctggaggcgacgctccaagaagtcctcaatcttcaaggccaagacgtaatcgagcttcatcttgtcctcgtccaagacaccgatgcgcaccaagcggcgaatcaatgcgttaccctcgaacaggcgacgggggtccttgtcctccaaagtcaagagctcacgggcagcacgacggatgttggacagggtgaaaccaatgcgccagatctcgcgcttgttgcggagaccgtactctccaacgagcttgagctcctggtcgagacgggcggcctcgaagggacgacgggggaccttgtaggtctttgagcagttcttgggagctccggaaggcactgttttttgtgacgagggtgaggcgaaaaggtagtaggtttagtgtttgtgcgttgggtccattatcccgatggcatagcaatgctcccttcgactccagacatgaacatggaccacagaagatcaaagtcgatgcagaagcgtccaaaggagttggaagggctgtaggatcatagcttcggcatgacattcagaccatgttgaatgtcagatctcaaacaagatcgaattcttcacttgtgtcagccgagtgcatagtaccattcagttccatccctcctttgaagttccatgcaacaatgctccactgatggctctgtccaagctgaggtctctgggagtgccatccgatgctgctgcagtcctggtcattactggctgaaagtgaaagaaggatccaacaaatttaggtctgtggcaaagaagtaggagaaaaaatgattcacgtacgcccacttgtacgtggccaaatactcactctcggagatctcgtttgtgcatccgacattgaagcgttccttcaccacacaatcccgccatggcccaccttgtccggcccgcccccttgcgcagtctatctcgcacaggtacgcgaagcgctctcttgccttgtgcttcagaaccttcttggtctgtccgtacggcgtaaccacccgagtgcttacagctcaacctcaaacccttccgcgttttgctcaccgtgccatctctatctctatttctccgtctgacggcccctgctctcgtacccagccgcacagcttgcgccgatcaaaccgtacgacaaaacgatctgccggaggacctagttccacgagcgcaataggggcatgaggtgctttacccataccaattcgcaaatatctcacgcccaatgctttgaaccggcaccatagatcctgcgcacgcgctctggctagtcaatgccgcgcttattcctcgacaccaaagcctagcggcactcagtcatcctccacctctgtgaaggcattcgcgaccctcggtgcaattgcagcagccgccgcgttttggagccaggcgcctgctgtaagactctcgtctttcttctcggatggtctcggaaaactttctgcatttcgggatttgggccacgcaggcccttgaacagccatgattcatcctaccacttttctgtgcatacatagaccaagaatattgaatgtgaagcgccaaagaaggaggagaaaaagcccagtaaaactgccgaggcggacaaaaagcaagtaaggacagctactggggcgcctaacaattcatatgtacaaaggctcactgtagatagattgcaccaatgctcgacctgatcacccctcgcgcttttcccgcctgcattttagaaactcgagggtttaacaaaagattcgcccatgcgcctgcgaatggaggcatttaacaagaagttgcaggctgagatcacagccgagatcgaacgactcgacggtcagggcaagttccaggttgatcaatggaaccgcgctgaaggcggtgacggcatctccatggtccttcaggacggtaaagtctttgagaaggccggtgtcggtgtttcggtggtgtatggcatgctccccccagcggccgtggctcagatgcgtgcgcaacatcccaacctggaggtgccgaaggagcccatgcccttctttgccaccggcatctcctgtgtcatgcacccgcacaaccccaatgcacccacggttcacttcaactaccgttatttcgaactcggagccactgatggcggtgagcccgtttcttggtggtttggaggcggttgtgatctcaccccggcgatcctgtatgaagaggacgcggtccatttccatcgcgtgatcaaggaggcctgcgacaagcacgatccacgctactacaaggactttaagaagtggtgcgacgagtacttttatatcccacatcgaggcgagcgtcgtggtgtcggcggcatcttctttgatgatttggacgataagaagccggacgagctctttgcgtttgtacagtcctgcggcagatcgttcctggatcagtatgtccccatcatgcagaggagaaaggacatgcccttcacggaagaagaaaagcgttggcaacaggtgcgtcgcggacggtacgtcgagttcaacctggtctatgatcgtggcaccaaatttggacttttgacccctggtgccaggatcgagagcatcttgatgaccatgcctctgactgcacggtgggaatacatgcacgaggtggatccgaaggcgcacggtcgtttgatggaagtcctgcgagctcccaaggactggattcctctgcaataaaaaatatagaactctcaaaagcgggcagcaaagcccgtacatcaaagagttaccacttctgtcacaaaacaaagaaagtagtattgatggtgcatgctatgtgtgtcactccaacgactgtgtaatccgtgctcagtcctttaaacaaagcaaactctatgcctctctatgcttttgttgcagtggcatcaaagatcttgttctccttagctccatgaatcgtcaactccctgaccttggcctccaaatcactgagctcccacttgttggagctcaacaccttgggaatatgacgggccaatgacttgctcttgaatccttctgctgtcgtcactgccttacggatatccttttctgttgctgctgcctcgacaatttccttgagtgctcctggcttctccctctcctgtcgtgccagcgccttgaacaaaaactggttcttcaagtcgccaggtccatcaatgagctcaattactgcaacaggtgcattgtctccgaaacggttgcccattttgtggatccgagtgtagccgccctttcggctcttgaaccgctctgcgagaggtccaaacaacttgggcaaagtagtctcgtgctcctatagcgtgccggaaagaagtttactcgttagccgacagtaaccgttaacgtgagaaacaaatggatcgtattcctctgtttctttccgcttttttctcctcagagtgacgaattccatatcctgatcgacgaatccaaagaaaagaacagaaacgtaccctgaggtaggatgcagcctggaccttggcgtgcaagtctccgcgctttccgagggtgatcatctagtaaggaaccaaagcacatcaaaatcatgttaaaacctcttgtcttttaaacggttttggcggcagagtgctccagatatctgtaaaaaaaagcctcttcgctattgaagtcaacagcgggagttcatatttcagccatgcacagcagcttgaacgcacctgatcagcaatggccttgagctcctgagccttgggcaatgtcgttttgatgcgatcgtgctgaatcagctgtgtgaccaggttgcggaacatcgacttgcgatgggacattgtcctgttgaggcggcgaaagtgctttccgtgatgcatgctgtatatgtgcctacgggcgtgcgggaggctgtgtgtgggagtcggtcgaggaggtgaaggacagcaggagaatgaccacagggcactttgaatggtgtgttagcggacgactcagagaacgggactgctcgtcaaggtccgaattgtttatcaatgaacgatacccttaatttttcgaactcgcacgatctatatagaccgtttattttccatacttggccaaccagtccttcttccactgactatcctccttgggtacaacaataaacctcgcgatgccgtcccgaagcacatgcttcgagtgttgcaaaaccgtcaggaacttgacgttcaatccaaccttcatcaggccaatattgccaccgttatcctccgtctcgaaatatgtctgcaccgtctcaggtctatacttgtgctctggatcccatggtgctggctcataaaagatctcggccaactgctctccaatgacatcctgctcgttgaatgcctggatcaggtccgactcgttgtgctcaggatacaaaaagaatgtaggaatagtcaactgatccaggtcctggtccaactgaatctcatgtgggtgatcgggcttgaatcctggcgtagccgcggtccggatcttacgcttctccaaagccttttcaatcatcatcttcttttcccgaatcttttgttcccgaagctccttctccagcctgatcttctccttgcggtcaaactctgcctgaatcttagcctgctcatccttgacagcctgattgtcgggatcggcgttcaaggcgtgctcgcagcagtcgatggcctctttgtacatttcaagggcatagagagccttggccgagcggaaaagagccttgacattcttttggttcagcttcagagcgtgggcgcagtccgtcaacaccatgcgataattacctgcagcacaatatatcaggtgcaaaaaagaagggagaacgaaacttataagcaccatgaacgacgtgttctagtccatcgtcaacgctcgtcaatgtcagcaagaaacagtctttaccgaaatggaggttgcaagcggctctgttgacatatagcgtctcgttcagcttgtcgtccttgcaaaagacttccagcccattggtataaaacaggagcgcatccttgtaaaacttcttgccctgtttgaagcaatcgtttccctggttcttgaagttctctgccacctctatgaatcgtagcaacaacagcaacagagaacaccgaatgtttagctgtctgcaagcgaacgttggctaacaagtgcaggggccgcagttgcgtgcagagtcttgcagtgcatactcccaagctgcgtttaccttctggcgttccatcataggccaagtcctggagggcttgaatcaatgggttttcattggcgtcctctggcaaggaattcataaacaacggaacggcgtccatggacttgtgcaagttggtttcgtccaaggcccaatcaggacggctcggcctgtctggcccaggcaacgggatgccggttttagttctcctgatgccgtcgtctgtcatgattaaggtacaaagtgcagaggtgtggttatgtcgtgacgaacggagtggtagtttggtggaaggaagcaaaggaaagcaatggaagtatttttttttttttgtgtttgtgtttgtgtttgaacgttgctgcaaatttggtggccagttgcaaaatcgattttttcttgaacaaagtataggtctcgccagaaagtcatcgactcgatatatttttgcgcatttgaacttttgaattgggtattgaatatgtacaccatgagagtacgtgacatgaacaattcaatgatttttttttttcgcgtcaatcttggcctcgtccctcggccccatctccctcagtaacacctccccaacaggtcctacagcaacatcaaagttgtcgtcgattttttggagcctccgactcataaacaagacgtccccctgctcctcagataaaatgcattgggaacgagatcagtgtcattgtcgtcgtcaacttgagcgtagttcgacattccaagcgcgttggtgataggcgtctttcgcagcagacacccgaaacgttggatcaggcaggacgtgacagccccacccttgatcgactgatcaaaggttgttgtagtagcaagctacttttgcaacaggtaactattggatcaggcaggacgtgacagccccgccctttgatcgactgatcaaaggtgttgtagtagcaagctacttttgcagcaggtaactattggaacgggcggggcgcgacagccccaccctttgatcgactgatcaaaggttgttgtagtagtaagtttcctttacagcaggcattcgttagaacgttaatacgggcagggcgtggcagtcccacgcttcgatcagttgatccaaagtctgttatagtacctatatcgaccggctctttatataatacacttgagtgtatgctggcgcatcccaacctcgtatccgctttacttatcaccctcacccgccatagcatccatccctgagcaaggtaagatgatacgcaaggcaagatgatattgataccattgcacacactcgccaacacacatgtttgacacatccttgggaacaccgctcgacgcagacacatcacccacacatcccacacctcacagacacctcacgcttccctgcacactcactctctgtccctcgtcttgcattatcatccgcatgttggtttgcactgtctgttgttctttctctttcctcatctttcctcaccctctctgaatctgtctccccccctctctctcttctctctcgtgtctcgctctttccctcccagtctgcctctctctcatgctctctctctcctcctctgtcttcgttctcttttctctctctctctttccacgtgagtgacatctggctagcaggttggggaccccaccagagcagaggcgcgccttcgcttcggtggtctggccatccggccgtaggtctcccacccgcgtaagcccccatccaatcacccagttcagtactggaaccccttcacgcccctgacatcggtccgatgcaacgggggctcccagatttactctgggtttaccaaggtttagccagtggctcatcactttctggcaagacctataaaatctcattttcatcctcctccggcttttttcaggcgaaaagcacgttgaaggcagcgcacggcccccataagaggagaaagcccttaagcggagttttcactctcactcatctcgcatgagagtgaaggagaacacaattcacggcgaccatggcagcatcagaacacgacgaggattgcattgattcagaagcagaagaagaatacgacattccttggcctcgtctctcctccccgtcctactcggcctcacgccccgccccgcgatggacgcccgttctcggtccgacgcaggtgctggtctttcccgactttctcagtccacaggacacgcgtgcgctgatcgagtatatccaacgacagatgaagatccaaatcgatgataaactggacccgcaccaaccacggaaaccgcctgtgccccgacccggctatgcgttccgagacaatgaccggattcaactcgtttccaaagagttcgcggcgatgctttggaacaagtgtgggttgagggatcgatggaccgacctctgggagcatcccacttggggtcttgagacggtgcagggtgaaagcattgtaaggtttgcaaatgaaccgtataggacagtggtgtctgcttttttcttgtttgcgaatgtgaaagtgcactcttcgtttttgacgaatgttcaccaaccaaaaaaaaaaaaaaaaaattgcgtttctcgtttttttagacgtcaggtcccaggaacaagaggagagtgcgccatgctgtgggattgagtcgcaatatccggttctaccggtaccagcaagggcagtcctttggggctcactacgacgagtctgtggtagagcaggacccgagcgacgagggcgaagccgtgtcagagtatacggtgttgatctatctcaatggcgagcgggactcggatctcatcggtggagagacagtgttttaccccaagggcaagaaaaagattcctccagcggcagcaaccaaggccacttcaggagccgtggctgggaagcaggcgaaaaggggtggtcccaaggctggtcctactcctggtgcagtgccagaagaaggagcaagtggtaagggaggaggactgtcgtataccctgcccaatggaggggtggctgttagaccagagcgcgggctgcttctggtccacaagcacggagacgactgcatgctgcacgaggccctgatggtcgatcgtggctacaagtacgtgctgcgcacggatgtgatctacgagccgtaaaagtcttggaagtgtcaaatgtaggccaaatggcagtcatttttttcaacttgttgtgaatcaagccaccaaaaaaaaaaaaaaaaaagtcgaaagtgcacctggctcgactcgctactttgaaaggcatcacaactgctttttctgcatctcaggaccaggactcttgaaccgtagtgtgtctcgactcccagcaccttctcgccccgtctcccttccttccctctctctccatctctcgtttctctcggtctctcctcttcttctcctccacctctagccaccaccactgattcacttgccatgggaaagaaacagtttatcgaccggaagaatgcccgccacttccacttggtccatcgctcccagcgagacccgctctctcgagatgagtctgcgccccagcgagtcctgaaggaggtcatccccgccaacctcatcggaaaggtcgctgtgcctcaggaggaatttgacggagacaactactcggacgacgacgacgaaggcgagaacctctttggggagccagcagagcaggatggtatcaactacggcacatacgatcgcaccaacgaaaccgtcgaactgctcgaagccccctccgcctcgtctgctgcagcctctaaaaagaagaagcagagcacctccaagaatgaagcgtaagcaaaaaataggcttcacttgatcattcacgtcgatcctctccccccttcctttgcgttgacctctgccgtttcctgtttctgccacaaggcccgatctatccttctctctctctctaactaactaactaacaaactaactactgaaacaccatctcacacttatagaaagatcggagaggccgcattgttgggtctggttggcgaggacttcaacgatggatcatacgactacacacagcatttcaaggagatcggtacatcgtccgagggtgtcttcatggctgcacctaaggtagccgcgcaacagaagaaggccgctcagcagtctcgcgggatccagttcacggacgctgacgctgcagaggaaatggccaaggacccgcttgcagccactgctgccagtgccaacaaaaccaacaagggtcttcgcttgccctcgggagtgctgccttcgagagaggagctggatttcgcggatgtgtaccaaagtgccgtccccatgggtcttcagcccgacatgccctacgatattcgagagaccctcgaggccttggaggatgaggagtttgtggacgatggtctggatgactctttctttgatcagttggatggcgacgatggcgatttcggggatgagatcctggaggaagattatgaggatgaggaaggcgtggaagctgcgggatgggaggcggatttcaaaaagttcaaaaaggcacagaattacggttctgaccacgacgacgattcgtttgagggatccgacgacgagtacagcgagagctcccggtcgtcccgtcgccctcccggcgcctcggcctcgaccttttccatgtcgtcctcggccatgttccgtaacgagaacttgacgttgctcgacgaccgtttcgacaagattgagcgcgagtacgaggactctgacgatgattcggaggaggacggacaggatttcaagggcgaggagctgcgaaaggactttgattcgattctggacgacttcttggacaagtttgagattgtggggtccaagatggtccccaggttagagggtgccacctccgagaacaagctgacgaccatccgaaatgccatgttggtcgacgaaggcgaggaggagcggtccattgccaccaccgcaggaggcacgaaacggtcgagcaagaagaacctagatgacgacatggccacagagttgcagacggatttcaggagtagggccgagaggatgcgtgataactgggatgtgcagacgattctgagtaagtcgagaggagatgtcgtttatgtgggtgctcagcatccacataaaagaaaaaggacttgcaaatgggcttgcttcaaaatttggcacagtgtgcctctggtttgtgtatgaacgttattgactcgtattgtttttgttcttttttttctcaactaggcacatactctaacctggataaccaccctggtatgatcaaggagcagtcccgtcgcaggatacacatcgatcccaagacaggcatgcctgtcgtcacagaaaagctgtccaagaaggcactacagcgccgccaggagattgcagatgctgctgccatggctgagcggggcgaggaaggatctgatgacgaggaggaaggatccgacgacggatcagaagactttgaggccgagaatctgggcgtcaagcgcaacaaggcagagacaaaagaggaaaagaaggcacggaaggaggccatcaagcaggaaaagaaggtgcgcagagagaccaagaaggccaccaagactgctttcgcatccgagaagtccaggcaggagaaggtcatgaagaacgtcaagaagggtcaaggtgtcacgcatctggactaagcgactcgttcttgtcgttcccttgtcccttatcaacttggcgcctttgtccttcatctgcattgcatacaccctcccacaccctgctcgacttcagcagcttctcactctctcccgccctgcatctgtaaaagatatcacgaagtacaatatacacactgcatcactcgatatctgtttcgtgaagctgtattgcagttgaataatgctgcgaaaagtgcaacctcgaacgcgttggtcgcgctacaataccactgcattgattgtctgaatactacgtcgcatcatttgtcaagtcgataatttccagttcttgaagatcctcatagccttccatgtccacgctggtcaaacactccttatccggatgttcgggtccttccttctcttttgcttctccttcctcagaatccccttcatctccaaagcgctcaacaaagtcaacgtccagtgcacactcgaacagttcctcaatcacgctgaaagccaagcgcttgcgctgcgtctccttgcgtgtcgctcggctggtcagagacgcattgccctccatgctctccagctcacgtacagcttctgtgccacggtagtcagccgggcgagccttcttgtccgctgccgcattctcatcaagatcgtagcccagttccacctcccttcgtttcgcgtcttctgcaaaccactcaaacaattccgagaaggccgacgaacacgacgacatggccggttggagacgtttttcgcccgcggcggcaagagcaccctgactgatgctgtcctctgtctgagtggatggaggtcctcttatcggaggctgctggtcggactcaatgtccacgcggtccaaatccaagcgcaccaatccacggatcagcttctcgtacaacttgtgcaccttttgctcttgccgcgtcaggcgtgggatgaccacttcataccgtcgaaacagattggacaattcaatacctattcagcaggcatgttaatatacgtggctatagaaaaacaatagacacgcactaaagtagaaacacattctgacatcgatatggtccccggcccatacctcgctgcacaatctctgacggcatgccggccatggctgcacacgcaggacccagggatgcgggtgttttcccgcgtatgacatgaaacaagaacgtcgcctcgagaccattgcgctcctgatacacctccatggtgtatagtgaaatgggcagagtcaagtccaacagcctgttctcgaacagctcgtggaaatgggttgttgccagtactttggggcgatcttccgatggaatgttggcaaagtgttcaatcagaccgcaaaacaaaccagcgccatctactcgaaggatttctcgatgagcgttgctgttactcatccttctttcaagtcatgaccgataacgatggctgccatcatgcctaccagttgctgtggttcctttaccaaactcatcgagtgctatcaatgaccgtctggtggccatcctgagcgccaatgtcacttgctgtaaatctgtcatgaaagcgctttggatctatttcgacatcgattagcagagccgaagtggggcagacagtcaacaactagaatggcaacaggtcactgagcagtcaaagaaaaatcaataaatggacccgctcttacactcgataccgtctctcgagtctgtaagcgtgtcaggatcttgtccgtgagacctacaacggccgattccgcaggtacaaagctaccaatatgtgccatgaaggtaatcagggccacctgtgataaagattgtcggaaatatcaggccttcgtgttcgttggtgacagtgatgatcaagtgacaaggcaaagacagctgtgcacctgttttaaatagacgctctttcctgagctgttggcgccgctcaggatgatgatatcgttctcgactctggtttcatgacgccgaaattgggattggcccccgtcagcagtcgcttctgtgctcccgaggccctgagcatcgccatcagcatcggcgtgtcgttcggcattgtccccgagcgcagtatcattagcaacaaaagaactgacgacgagctcttgcaaaggatgcctaggagtgaacacaaaagggaatttttttcaggcaagacatggctcttgcttcttcttcatttagcgagaggaggtcagaacaactgcttaccggccattcacgatccggaggatgttttgctcagtcattttgggacgccggtagttccttagccgtgccacctggcccatagccacaagtctataaagcaacgcacgctgatcagttgaaaaacctcccttctgacgtatttcgacagcatttctttctgttcaataaaaaccactgccttacacatccagttccgcgcagagatcactgcaagtgacaagaaagtgtcggtgttccaagacgcgctcttgtagtccgtgcataatgtcaatctcgcgatctaatggttacacacaacggtgttatgaacagttcaagatcccctgactccacttcgatagagatcatcaaggaacctgcctactattagtccgtggatgtctccgagatgttcatccagttctaaaaatcagcgacatggtatcagagcaaacaaatttatggactcttctcaaattacgacagcacccttgcacgagaaacgatagactacctcgcatggagttgttcttgtagtacacagtgctatcagtgcaaaactgtgccacagagatagcgagatcagctaatccgtttcaaaccctctttcacgtagtcagccgatgcaatctcgcatcaaagaaaacactgggacccggtacctgatagcttaggccagccagagaaaagtcttgctcattcttccagttgggatttctagggacagtgatcagatatcctagctgtggaaagtagatgacgttgatgaccgaagcgaaatccgaggggatggtcatgctgatctcctttgcaatctcggacaggaagctgtccaatccatggtatgtttggcgcatgtgatccaattcttcatcgacattatgcttcacaacacagcgaccttcaatgatgctctcgtcaaaatccacctgcaacggaaattgataaaaaaaaaagtaaatttcgagtgtcttacgactagtcgaacgctgccgcttttatgcctcacgctggaacataccacatcattgatgttggctccaatgtccatcaggcccttgacatcaaagtattgaagtatctaacaaggacgggtacaatacctgtcagattcgatcctaggacgcgtaaatctcctagacctcgttttggctcgcaggaaagagtaatacgtacatgcgagatgatgggtgcttcgccgacaaagatttctctcgagacgtgatatatcttgaggcagtagtacacaaactagatttcaaagtcagcgctagagaacaaaaacattgctggccttcatttaagacagagtaagaatttgccagttacctgaagtattgcttgccattccgcaatggtcgccttccgtggtaacgcctgaagaactctgggaatgttcttgatgtgcgacaaactatcgataagctgtccaatggtcggctgattctcggtgcgcgtaaagcactcgacagtctgatgacgcgcatataacactgcaaggtcagtcgaaggcctgagaagccactgcttcagaaggtatcgaccttgtggcgtctttgtttgatccagaattcctacatgcagggggtgagtacggcgaagaataagtttgactgttctccgcgtagagcagagcagaagagggcaaaagaatagaccctaccaaagagcgataatccttccttgcgaccgcgaatactagtgtgcatgctggggtgcgtctcgtcctcaaatatttgcagcgaactgtgcatgaatgccgttaaaagcgttctgtacaacactaggtatattttcgttactactccgatgattttgcccaccttagagtgtttggattgacaaacatgaatgagtcgctacaatgttacattcatgatagggtggtcaaatgatgcgcagcattacagggcaattgttcaagagatcaaaggtcttgttacgcgtcaatacatacatgacaaaggattcgatggaaaatatcatgagtgaatgtccattcccgctggaccgctgcggtggaccctgcctgaacaagaagctgataatagcgcccgcactcgcaacctacattgcacagttcattctcagcgctcaataacattgaaagtaaggtcgtttttgcatttgtgattcgcgccgcttttctcacttacgctctctgtgctttggatatcgatcagattcgacagatagatctgtgcatcacgctgcgaagaatcgtgcatttctgacgaatgccactgtgcactcatgcagtccaggcttctggaggtggtcgagtttcctctggtgtttgccatgtgggtggacactgagatgagctttgatttcgccgtcgaatacgaaaaatcgttacccgagagcacctcaaccttggtttcttcgccagtttctaagcgccaggcggagcaaacagttagaatgggtctcgacctctaataggcatcttggttgtaccaaacaagtacagcatcccgcttggacttaccactgaatcggagtgcgtccatcacgacatcatccaagcgtgagcttgacaaaatcaaggttggtcgaatttgcaccttgactatcgtgacatgcaaaatccatgcaggcgtcagatcatcatatcctgcaactcacacatttaaactgagaccataactgcgccgcatgcgatacatactcagttcgatggtctccagagagctgcactccaccatatcctgcattacatacagcttggccaagtgaccatcgtagtacgcgcagcctaacgtgcgacctcgcatactaaccgccagtattatctatcagccgaaaatcaaaaaagggcattagattgagaaaatggctacagtacgccaaggaaagtctgttcaatcattcttgttaattcaatgcgagcttgcctctggtccaagaggtaaatccgatgaggattctgggtcgtccgacagctgcacttggggctgttgagaccgttgtcgaaactcatccgtccagttgttcgagctggttgtttgacaatcatacactgctgcgcgctgcgatctgcggtgccgctgctcttgtcgcccctgcgcctgtgctcggctaaacgtgctcgagaggctagggctcgtgaagttggtggcgtgctgtccatgggactggagatctccatacggtgaactggaggcaagctttgacggctgcattcgaggcgtaagtgagtttcttcttgactgagcggatgctgaagacagcgaagaagaagcccgactttttcctgttctcgcagactgcgatggtgcgtagctagctcccacattagagctagacaccatatcgaatgatcgagtcgcgtgcggctgagaaggtgagcgtacgaaggcaggagaaccggaagagtcactaatcggcggccgtttgcgcgggaagactgcaggtgatacaagaacagaagcgccaccgctgtagccttgggatcgcatggctgctcctcttgattccgacacctgatccggtggtggtgacgatggtggaggcatgtaggcctgtgatgagctggaggatgagccagcaactatggcattggggagggcacggccatattcagagatgtggtgcggaagcatggtcttttcaaggcgggaagccgaagagaaaaatggcaaaggacaacgaacgcggcgaaagtgcgactgtgaatttatggaaaagcattagatttacaagacagccaattattgtacagcaagggaatgcacgagctagagctagggtatcgagagcgcaaaatgcagaatagacatggggagactaagagcaactcagctccggcggaaccgctgcatctcgtctgggtaaaggaccttgtcccgaagctcgcggggcagatagcgatgcagaagcgactcgagcgacaccttgtcgttcgtgagtcggagtcggtccatgagcagttcgacatccgtctcgtcaatcgtcctcctgcctgcatgtgctgcatacgccgcaaggtcattcgaggcttgctccaggaactggtgggatctaagggaacaacacagcaggcaagtgctcacggtaagataatgaaaaccgagtaccgtccagtgacaagaactctcgcagttagatacatacccctccataatgacagccatggcttcttgggacactctgctgcgcgaaaaagtgtggacatgttgcttctgaagtgctgctggcatcgatgggactggaatgcctgccttagatagcctaaagaaacaaagaatcgacgtaacaagtcagcaatagctctctccttagccaaagaacagcatcgcgtcctccatgttagcgaaacaaacatatgcgccaacttaccgcacagtcttcttggtcttcgggaaaattgtcggcagcacgtttccattggacatgataccaagctcgcttggaaaatcgtcaaaatattgcacgccagacggcccttgccgttcctcatgttcctgcagctcgacgtgatcctcgtctggcacatgcatataatcctcctcatacctctcctgatcgccttgcgcctgacctgagaggtctgcccctagttgttcctccagctccaagtctgatgtatgcctttgctgttcctcagtattgcgatccggttggtcctgatcattctcttgttgtgccattgtcatatcgaaaaattcattgaccaatccttcggcaggctccataccctcgcttgcctgctgctgctgttgctgctgctgctgctgctgctgctgctgttgttgttgttgctgctgctgctgttgagaatccaacatgccacgctcattctcgtcatcgggtatatcctcccatccttcttcctccaaggtctcgtccgcttgctgctctaacaccaagtgccgaacgccgttcgcatcaacatacatctgaacgtctcgtgcatctgggtcaattgatccgggtgctccctgttgctgctgcgagacttgatcagcggacaatgcttggtcagcctcagatccctgctgactcattgacagtgccagcgttatgcctggtgcttccgaactggtggaaagtgaccctgggtcagtcgtcagccctgatgctgcttgctctgatacagacccataatcgccctgatcttggaccgctccttccttgactcctcggtttgcatcgccatgatcttgtccgggttcctgttcctgtccatcgcccattccatgaagagatccagctgtaagatcctccaagtgcagtggtcgctcctccaactcgatctggtgcaagaatgggtccgtcatatcgtgttgtgacaaacgatgttctcgagtatcgtcgtcttcgagcaagctacggccctcgtcgcccgctatgcccatgccaaaagatcctcttccgctgaagcgctggctcctaccgatgcttaattctgcctcccacagcttgttaaagtcttcgggatcgagaaacggattgctgctcctgaagttgtcaaaagcgaggcgtttctctacagacatggcgttgcgatccagtgtgcttgaacgtgaccctgagagtttctcggatccaaaatttggtgctgcaggaatcaggtctctgtcacccggcgtttgaaagtgcatggttttgggcgtctttggcgtcaattttttccactggtcgcttcctgggatcggctctctctctggtgagggtttgcggggctgattgaatcctggaactacatgcaacggagaaagtgttttgtaagagatcgaagcgctcgattgttcgtcttttcccaccatgaagccgtttagtgctgtcaacttacctcgactcagtgctctgaggatattgatgggcgaatgcttttctcttcctgattgtccaaatcgtgtcgcctcgtgaatcattttgttgatgcgagcttgatgagcatccgccatggctttgaaggccgagggtttgacgttcggattcataggtttggaccggcgcctcggtgtgcgacgcctcggcgttgtatgtgaggtactctcccgtctgggagtttgcggagcactggcgaatagtgcagaatccaggctttctgcaagttgattttcggtgactttatcctggtcctttcctgggcggctcaagtttagaatatctagcagatcttcgtccgcgactggtcgccgtgtggtcggtgaggtattcaggtcccttccaaatataacctctcccatggcaccaatgttccgccgacgtagtcctgttttctgctttttgggagttgtaggcgggttaactaactcctatttttttcgatgaaaaaacaaagaaacgcacaagtgttatgtcagaatagctgatagtcgttgagttcgccatcctttccttggcgcaagcgacaacgtcgagtggaaagtcgcgtccggtggttacccttgcttccggttgattgtcattgcttgtccgtttgcggctggcaatgaatgcttccgtgataatttgttgctcaggttgctgatgattgcttccaggacttgaatctgtgtctccatttagtgcgcctccgcgtgctacacttggccggacctcgacgcttgtcagatgcaggtgctcaaagagatccaggtccacgacagttcggcggttggcggacgacctgaatgcctgctccatggggccatagttgggtcttcgcaatcccgccccagccggtctcgcccgttctctcgaggtcaactccatctgggattcaagggtcggtcagcaggttgtgtatgtggttgtaaaaagcgccaatgtgttgagaaggttaaagtcaaaacgcggatggatcagatgggcaagaatttctttaaaaaaaggacatgacgtcacgcgctgcatgcccggcgcaaggcgatctttattgccggatacttttggctgcctgaagaagcccttggagctcatcaccctcgacctggcgccactcttgtctaggccgaccgacttgaccctgccaccaaaccaagccctcacagctatcatgcgcaaacagggtccgctcgcccgtcgtctcgtctttgggtccataccaaaccttctccacgtagaccgccaagggactgtttcttccaaacaggaccactgtactcgatcgcgtcccgtaatccgcgtctgctctacccaggccaatctttgggatgaacacacgctcccgtagagctccaaacgtatccacgagatccagactgccttctgggaacggcgatgtgttatgacgaaggagagacagcatctcgattaccagccaggctacctctctggcatcatcgtccatagcctctgagagactactctgcaggtgggcatggcttcccgtaccaaagagctctacgctctcattcagtgtcttctccagagcctgggcgccaatcttgaccttgttccatggagccgaaaacaccgaattgctcacaccaaccaccgacccgggaacaatagcacgttggtctttggagctgcttgctccagcatccactgccgtccatacagaagacgatgcttccgatgcttcagcgggcacctcctgtgtcttctgcagtgagtactctgtcgcaatggcggcctttgcagattcagcgtgcttcttgaagatcatcagctcggatccctcccggttggtgccgatgtattgctggtcacccgcgttctggaccacaagcaagttgagtccttcaaactcggtttcccatcccttggcgcgcttcctgatccactgctccgcacggtccgcggcgactgtgctctccttggacgtgtccgcctcggcgctgtcgtgcgcagccgccatagtgaccaagtattcgccacacactttgcctctagagagcttttgatctcggatctgggacatgtaggcgatagtctccctgtagttggtaagagcgaccagatcgccgtgcgtcgtgatcccgagccaagttccggggaggtcttctgtagaaagcgtaagcgcgaccttctccgttccatcggctgtactttctacttcttggatggtgtagttgacggctgccgatggctggagatcctggccagagagcactccgatgtttgatttcgatgtagtcggagcggtatctggtcgagtggctcgctcgagaatggtatccaggtcccaaaagtcagctcgagaggtctcgcgggccatgaattcatctcggttgcttgcgaatgcactaatgagagcgacgaaagggtcagcgatcggccctagttgggcggcgtggaccgagtgagctgtgaacgtacagtttgaaccgagggtggttgctggtaggaagtgtccagaggaggatgcacatgctgggaatgaattgaatgatcaaataagaaagtagcgtgtgaatggaacaacgttctttcgtcagcaagtgagagtgggcaagatgcgtaatgaatcaaggcgatgtcgatgcggatgaggaatctatcgtcatatttatgcgccgaggacgggattcgtaaggatggcgaaaaggaacagacccttttgttgtgtgaatgtgtgtatgtctcggcaagcgtccggctcaacggacggaaccctaaagcggactgccgccctccgcctgtgcgcacggcccggccgatcctacgcagctcgctcgctcttctcgctcttcttcggggcatgatgccgtcttatgggcgcaatcccgatcgacaggttctcgacatcaaagacacagtagttgttgcggatgaagacgtccccaaatatcatcacctccccaggcgtggctgtcaccgcgctatagcaccagccagccttcgtcttgaccttctctcgcaccaggtctcgccgccggactgcaaaccactttccgttcatcgaaaactcaatcgccccgtccttgttcgagttacacggcaagatccacccctcccacgggtccgactttgctccaatcgccttgttgatcgtcttggcttgtgcggtaggaaacaccagcagcgtcgtgcccgtgtccacaatcgtttcgcctcccacccttaaatcctcccctccgttcaaccgcacgccatccaccttgatctgccagtactttggatccgtaatgttcaagtacgtgagctcaccctcaaatcgcgtcgtgtcaatcgatccaaagtagaattcgccatcgccgctgtccatcgccttctccctctctccttcttgcgacacgacctcatctccatcaccaagccagaccccaaacaccggcgctggtatccgctcatggttcatgatcccactcagcaccgcatgactgacccgcaccttctctgcctttcctgagtgcccctcgacgccatctgcttccgctgcggctgatcctagagagcccttgatctccttctcctccccttcctccatcctgagcgctgacagcgcagggaaaccaaggccaaagacgccgtccaccacatcctcgagaaaactactcgattcacgatctgccatcccaaaaagctggttctcaatcgtgatctctgaaaactcgagcctgtccacagccaagtgcccactgactgccgagccatcgccatacgcaatcttccaggctgttttcagctccgtggccgtgctcgagagcgaaggatcaaagcgagcgtgtcgattgcatttcggattgtgctcgccacatttcttggacgggatccatagatcagacgaaccagtgtccatgtctagcttgaacatctggggtggggtgccgatcccgactatgccatagtactgaggtataaacggagagagagtgaaaaagaaaaaaaaatggacgagggacggggacgaggtagatagaatgcagggggagcagcggaggtgaaaatgaagatgtgaagaaggcatacaaatgaagcaaggaagcgctgtgttaataagcggtggactgatgatctacgcagctcaacatttttttttctggttgatcaattctcctgtctttttttcatcatctgccctttcttgcctcaacatcattatcgacatctgtgagagtttgccgcccaaagtctcttgggctcagtcgactggcatgtccgtactttctgagggtcttgagcgcgcgtgcgcgggtatttggacggtaatgtgtatttttgtggatgggtattctttaccgggcgagagggagaaggcgagaaggggaaagagggagagaggatgaggtaagatgtaaggcgcgtttaaaggaggcctacatcaagcagacactgagcacgagaaatgcagtctgaacttacttgaaagccccagcccatactgtctcgatgctgctgcagcccacacacgctgccagcgtgcaaagggctgtgttcaagcgtctcatgatggctcctgatttttctttcttcttttcgtcaaggtatcgaaaagaggaggagaggactttgcactcgttgagggatccgtcttgtgaatgtggcgcgccgtgggaaaaaaggtgtgtgggtgagctgtggcaatcaaggagtgcacacgtaatggggtagtttgtgaaggatgtatcaggagcaaaacgcgtcgctgtgaactgtgcacgaaaattcaatgaccgactgccttgtgatggcgatattgtcaacctttggtggcaagtcttggagcagtatgagggggcgggcggatggtgaattacgagaaaggcgaacaaaaacatcagggtgctgctctcgggtccatctgtgcaacgcattgttgccgttggggaagggagaagttcacccttggtgtctatccgaatacgatcccttctcaccccaaccgtcactctgcacatcagcaaacttttttttttgtgggcgaagcaaaatttgaacgctacaatcttgtgatcctgctccacgtatgacgcccccaagtgactcgagatggcgattcaccccaatcaataactttatccttcaacgatttacatacgttcgcatagtgcttctgatggcaaggagcgcccattcgatggcgaacaaatgttcgatgagaacaatgccgacagtggcggcgtgagacaggcatttaccgcgcggcaggcgcgatttatgtctaatctttttgatacaaggttaaaatgcttttgattgatagcgcgtgatgttcgtgtttggtgaatgaaaactgaatgatgttttagagacccttgcgagacctcgttctcacgtagatggcctatctatcgaggaggggcgcgcactagacaacgcgtagcataagtcgaggaagatgtgccagtgaattattcggagacaaggatagatacgcatgtgaacaacacatatcagtgtttcctcaccaactctaaagccttataatggatatttcgctgaatcagttcatcgcgtttggcccagaaggcggccttctccctcctgaactccatctttgcctcgttgagctccatcttgaactccgcctttgtcactctgaattctgctatttctcctctgaactccagctttgtccttttgcactcttccctatctctcttaaactctagcttcgcctcgtggaactctctgccttctctcgatccatttcctctcgacggcgttgcatcgctgcatcaaactctctttcattcatcttcgataccatgtcttgcttctgaagcatgttctgaagccagcctaattcccgctgctcgagcacctgttcccgtcgtcgtatgtcagcccatctttcgtcctgctcagtcttactgacattgtcgaccgctcttgaaagcgcagcagcgcttacacaactgggattgttgacgttgagcgttgccatccttgattcgccataatcgatatgcttagcatgctttggacgcttcgttgcgctctcgctgctcgtctctgtgttgtgctccctttcagaccctatttgcgtgaaagagaggataacgtgatgcataagaaggacgtttgcaaggagtatatgaagacaagacaaccgagagagagagagagagagagagagtgagggagagtgagggagagcgagagtgagagacgtaccattcatctctgagggtgtagcatcttccgtgttcatgtcgctatcactatcttccgaggattcaacggtgatccgccttcctccatccaaagaaagcgggtttgttgccagacttttgcccatgactgcatcaaaccgatctaaatacggcccagctcgagtactctggcgcgaagtctgagcgctccatcatctccttcgaccgtactactgacctttaactctttggcttcgctgtatttcagtctggcatactgatacttctgcttgaccgtgccgcagtcaggctctcactgttagctgtggctgcattgacctactgggcgattcggtcgtatatgtccactgttctttcccccggaatggttttctttttgtggagcctggcgtaattgtcgggttgagtgacccagtcaacaaaggcagccaggtcaggctggatccaaaacttatccttactctttggcgttgtcaatggaggtgtggacgcttcaggagtggggactgagggaagggtaggggcagctgctgaggttgagatggggattgttggcgccaaagtgtaggcagttgcgctcagagtactgactgtgaggtttgggatcgcaagtggcgttgctggaggctcaggattgagaagcctcgtttgaatgtcaagaggtcttcgcgtcgtcattggtggcaggatgttgtcttcaagagcagcgaatgccatgcgataagggacaatgtgtgaggttgatgtgaaaacaagggcttccagcaagtgtggattgtgaacgatgttcttgtcgtggtcgcagagagggtgcctgaaattcttcggcctcgatgtagcttcggagaaggatcgataggcagactgtgttctcgacagtccgaccttcaagatatttgatggaggaggaggagcggaacggtgaggggggaatcaggctgctgttgatgttcatggaattgctccacatatggacttgatgactgtactttttccttgtcctatgctccttggtgcaaagtgcaacaggctgatagaaactcgagcatttttcgcgcacatttgagcacaaaaatctgatgcatcccataatgcattccggagtttcgtaacccactatatatacaaacattcgtcttactatagttaacaacgaccatggggctcgactggagcgtcaagttgagatggaacatgtggctctacctgcgggtgtgagggggaggttgtaagacccccaatcatcagcagggccagttgagtaagggtccgcaggcatggctatagacgctatcgacctgtggtcaagaaagtctgggtcagcacacctcggcggtgtgaggacaatcccatatgccctactcagacttcagtcgggcgcagacgtcggtctgcggtcactttttgactcgtcgtacgattactttttttttttgcccttacaaaccgggggtgtgagcagaacgaagttccattccccaccctccatgcgtttgaagaaggtcattccaaccaaaagcgtatggttccgttgtgtgaatctaccactgcaggactctgtcaggccaccccgctcttcgtcagctaccgaccgcaagcacacgtgtgtcgtccgtccgaaaaaaaagtgtgcgccgtctttgacaattgcaaagacacaccaacgcaatgcagattccaaatcgtgctgaccttcggcctttgactacaacaaaatatgggcatatttatgagggtggggtgctgggtatcttccatctctgagagggattgtaagactactttgctatttctcagacgcgcataagcagcccatcgccattgcccttattcttattattgttgttgttgttgttgtcgtaggtggtggtgttgttgttgtgaccaacatgctggccctgactgcgaggactgagcgtgtcgtccgtctcgtcccgccggaaaaactggctgaaccctacaccactcagcgctccaactccatgacgctcctgcgagaccgtcccgtcctccaagagtccattgcgatcatcatcatcgtctctgtaacgccgctgttgacctggatggcctgccaaaggaagcaaatcgtcctcaatccgaggcgcgaacggggcatcgcaattgggcgaggacagcgatggatagtactgtctgtaagcaaagactgcaaacacaagtccaataaacgcgcccacgctcacatcctgccagtgatgacggtagtccccgactcttgaggtcgcaatcaaagcagcgaggatgagcggtgccagaacaaccagcgacttgtaaatgtgtccacgctcatcaaagatgtgcagctttccggcaagatacatggccaagaaacctagtcctccgaatgagaaggacgagtggcctgagggaaaggctttgaaaccgtcccggagaaggtccagacgcgtacagatgctcgaatcagaaaggaggttgactggatccgagagagggcgcaaaggcgtgcctgcctcggcgttgtcgtagagggacaggcagcgatccagaaaatcaggccggggtcgtccaaccgcaatctggacgtcatttcaaagaggcagtgaggtgagcgaggggatggcgttcgaaccgcgtttgcggtaaatcatcttttttggttgaccaacagacgactctgtttgggtttcggcactcccgcgcgcttatgagataagcatctggtaaccgagcgaggtctcacagacgggaagaccttttacccttcacaccctctcaacccctcagaagcatactaagccagtatagctcaccttgacgctgtccgtgacaatcaggacgagggactgagccaggaataagcccaagaaggcattatgcaagtctgtgtacgaccgtctgtggaaaacagcaataatcccaacgacggacattggcagaacgaacgccaggagctacggagcgtacgagacgaacgtcaagcagagtaaagtgaggtcaaaagaggtcataaaagaggtgagcaatgtgaacccgatggcctatgcttttttcttttcgttctgttgtccttctccatctgcatttcttcacttacaagaagcaaccaatcgggaatggtctctttcttcgcaaagggatgctggatggtcgtgtccttgacagagaactggcgatggaacggctcaatctggtcaatgagcgagaaggcaacgaggaccacgagaaccagaagccagtccttgctgtaggacttgcacagcttcttggttcgcgcctgtaggcgaagtgccgagaacatggatcagcactgagaagcgactcggggtgaggcgggggaggatggtcgaggggaagaaggtggagaggggtggggacagaaggagaggggagaagagtaggtgggtgagaaaaagagaaagaaaaagtaaaaaaagagttgtcatgacttgatgcatatgccggcgggaacaggggtcatcctaaaaaatccaaaaaaaaaaaaaaaaggaacaaagcgcgcttgtttggggtgcttgtctgtccatgaggacacctcaaccccacccatcacgctgcaccagggcctcctcggtgtgaccagccgacttccaagtggcctgcatccataccccagaagagtgatacatgcctctctcgctcgcgcgcacccgcatccacaactcgctccctctggtgccctcgtcactcggacgaaacatgcgttcatcggaggcagatcaaatcgcaggcattcaagtcggcgggcaaaacaaggtttactcaagttggttcattcagcagcaatttccagtctcacgcattcctcgtcaagatgcaacctgccggcatcagaagtcctccatgccaatcgttcccgcggtcaacaaagtccagagcatgccttcacaaacatgagagcaaccatgaatatcgaccaagagtacctggctgctttttcttcgcttacataggtcacggtgagtgagacgcgcttgtcgcaccattgactcttgatacatcaacagacatcgctgacacttgtgctcgtaccttgttcgccctcctttctcgacgctctttccccgtcccctccccctccaccggatcttcatttagtatgtcacgacttgttaccaaatgccggaggctggtcgctgtatggtgtcaagggagtgtgcgacccacgtaaccacttctgagatggcccgacgcagcgtattcatgtcttttttgattacaggatgtccacagactttgcaagattctcgattctgcagtcactcatggttcaaaggagctgtgaggtgagcttcaacctcccttcgagaagactgactgctccgagggtacgtgcacgcgcacggatcactggtccactccgagctggcggacgtcatccggaccactcaaactcctcgtcctcatagttttgcattgtgccaatatggctttgtctacaggaactctgtctgtatgtgcgaaaattgagccaagggggggatgaaagagatgatgggtattttcgatatggagtcgatgtacattgtgattcagaagtgtggccatgggcatcacgcgcacgcgcgcgagcgtgactgccaggtcgcctcaaaaacgactacaaaaggcgagcaactccgccttccccctttttacttcttttcttctaatcctcagcttttttttggtttggctttttgcctatcgttatcaaaaaaaaaaaaaaaaaaaaaaaaaaaatgtcgcgtctcgaatgtcagtattttcattgcaggcgcggactggtcgacaagaaaatcgcctttgaaaagcaaaaaagtcagctccgactaggtgcactgatcccaagacatgaaaggctcccaaagctgtctgccaacgatatggtccacctgctcaatttccattcgtccaggcaagtccgaatacatgtacgaaccaccgaaacacccggcacatccgtctacctgtccaggcgtccagacaagaacatggccctcatatgcatctgtggtaatgaatattggtcaagaatctccctccaaaaacattatctaaggcaatgtgcaaacacccccatcccgcctggcactgcaggaatatcgtaccaggacggctacgaggaccagaacgaggacggtgacgagggagaggacggtgagatcgaggaagaggagggcgagagcgaggacgacgaggaatatgttgattggccagccgattcttgcaacattaacagtaacatcaacaccaacaccaactgtaactgcaacagccacagcaacagcaactgcagcagtgcggttcgctcatttggagccgagtttgtcaaagctattgagacgacacgaagcttgcagagacagtcgcaggagcttcacctaacggctgtcaatcagctcctcgagcttcatcaagcgtcaaagaagcgcataagggagctcaggcaggaagtacacgaggaacgaacaacgagaagattggcgctgcaggcgcttctggaaacacaggccacgcatcaggaggaacggcaggagtggaccgtggaacgactctcgctacaagcgtacctggagacgcaacagaaggagcgccaggagactgaagagcggataagcagcatagagtcaaggcttaaaagatccatcatggcccttggagacgacatagctccgtatcgcaccccatccacatctgaagattccgtcctggctggcattaagaagcagtgtgtaagccccgctctcttgaattaaacgtttctttgtagtcgcgctttttcgcagccatagtcccaacccctcggagattgaaaagcgactttgcactgacccatgtccattgcaacaagcgactacttcaaatctgcattcagcttcgaggctcagctttggtcattgcatgccgaaagtgtgtgcatggagggagttcagcgagggtgagaagctgtctcctcataaccctttcgcgtcttttaatgttttcatgggggaggtgacagtgtgaaatcaagagagggcgattatggcatccacgccatattatcgtacgcgtctatccatgggcgcacttgttgaaggacacgcacgatgcagcggggagcacgaggttgtcttggtgcatccgttcccgcaggaactgaaaatcaataaaaacctgtgcaccaaagatcatttgcgtcctttctttctttccttccttgacctctttcccacacacacacgcacctttattcccctccatcttcctaggctccctcccctaccttcaactcacaacaatgacgcctgcaccctgtcactatttcaaatgcaagaagggattgctcgtacgaagagccgcctacaaggaacaaaaagcccggatccgacagggcttacctgtttcgcgcaaaggacgagtacagaaactgacggcaactgaaatgaagcacctgctcaatttccattcacccagacgactcagagtgaaaatgagcaaccggacgaccgtccatatctgtaggcgtccagacaagaatatgatttttatatgcatctgtggtaaagaacattggtcaagacactccttccaaagacattataaaaggcactgtgcagacacccccatccctcccggcactgcaggaatatcgtaccaggacggctatgaggaccagaacgaggacgacgatgaggacgaggacggtgggatagagggagaggagggcgagatcgaggaggacgaggacgacgatgaggaagaggacggtgggatcgagggagaggagggcgagattgaggaggacgaggactatgttgatgaggtatcccattcttgtaatagcaacaacaaaagcaacagcaacagcaacagcaagagcaataacagtgaggtgtgttcacttggagccgaattcgtcaaggcagtcgagaccacacggtgtcttcaaaagcagtcgtcagatttccaccgagcgaccctccaccggctcacggaacttcatcaaacggccaacgaacacatacaggagcttcgacaggagctgcaggaggagcgaactacaagaagactcatactcgaagcgctcaagaaggccgagatcgaaaatcagagggagcggtccacaggacgactggcggtgcaggctctcatggaggcacaggccgcgcgtcaggaggaacgacaggagtggtcggtggaacgactatcgctactggcgtgccaggagacgcaacacaaggagcgccaggagaatgaagagcggataagcaacatagagtcaaggcttcaaaaagtcatcatggcccttggaaacgacgcagctccgtatcgcagcccatccacatcagaagattccgtcctggttagtattagaagcagcgtgtcagccctgctcttttgaagaaaacgtttcttcgtagtcgcccttttttcgcagccagagttttaaaccctcggagactgaaaagcgacttcctgtacaatggcaaaagcaaaaacgacaagtctgcattcagcgttgatgttcagctttgattaatgaatgccgagtgcgtgtgcatggagggagttcattgagagtgagaaattgtctctcctcgacctttttcgcgtcttttactgtggaagacacgcacgggtatattggacgaaaatcaataataaacctgtgcaccaaaagatctttttctttcccttccttcccttccttgtcctctcgaccctttcccctccatttttttctcgaccttccacggacagaaatggcgcttcccacgtgtcattattttcaatgcagaaaggactgatccagcaaagagcagcctacagagaacaagtgcgccggttcctacgggggttgcctgttcctcgccaaggacgagtacagaaactgaccgtgaacgaaacgaggcacctgctctcctaccattcgcccgaacagctcgccgtgcgatacaacgggttgaccgtctatctccggaggcgtccagataggaacaagggccttcatctgcatctgtgggtatgaattttggtcaagaatgtccgttcaatgtcattatcaaaccttatgcgcacataaacccatccctcccggcagtccaggaatatcgttcgcatcgaaccccgacaaccgggatgaccgcagcgattgtcaagaggaccaagaggagcaggagcaggagcaggagcaggagcaggagcaggagcaggagcaggagcaggagcaggaggccaatgagaacgagaacgatggtgagaatggggaagatgctgaggaaaatgaagatgctgaagaattgacggatgaggcggctcattctcgcatcagcaacagtgatgtgcgatcacttggagccgaattcgtcaacatagtcaagtgtctacaaaagcggtcgtcagaaccccaccaaacgaccctccactggctcttggaacttcatcaaacggccaacgaacacaggcctgctatcttgaaataaaaggtttctttgcatacgcccacccttttttttttatttattactccgaacttgctccatgcacgcgatcgaagccgtgggaactaattccagtgctttcaaaaaggaaattgttgcgtatacaccttttccacagaagcatgtattaataatggtgcgtttgtaagcttcttacagaagtgccaactaacttggtttctacggagctgtgtgatctagcatgtattttacgtaggtgcaggatgcagtgcgctgcggaaatcggcttatcccgaagagagaaaaccgatcggccgcgacatcctttgctcaggaacatataaaagctgtcggccgacccctgtttctctcttcattcacaactactgcacaccattcttctttctttcaagtaaataacaaccacaaccacaaccacaaccacaactacaactgcaactccaaacaatatgaaggccattatcgtcgaagaaaccaactttgagcccacctaccacaacgcgaagctggtcgatctccccaaacccgaactcaaagaggacggtcaggctctgttggacgttcacgctgtcgcgttcaaccaccgcgaggtctggatacgcaagggagtgtatcctgtaagagatattatagatcataatttgtgctaccgtgtttcactttgtctgacgtgattttgtccccctcagatttgtgggcagtgatcagattcgtggagagagtgcaaaagatcctgtttgtactcacccattggttgttcttatgttgtgttcttttgttcaggtcattgtgttcgactcgatcatgggagcagatggtgttggcaggatcgcggagctcaagggcaactcgtccaagcacaaggttggcgaccgtgttgtcgtcatgccctcgatcggctggaccaaggaccccaggggacccgagggggaccactacatccttggtggtggacctgctccaggtagggattttgctttttttttttgtttatcactggtgggaaacaagacccgctgcatcaaagagaaaaattaggatgggagcaaaatcgttgcagcgtagaacaaaaaccgtttactggtgcggggttgggtccttttttacacatccattcctaaaccattgcccgcatctcgctatatatgctaggcctcttttcggagcactatgtcgggcaacaggacgatctttttaaggtccctgaccacttgactgatgccgaggctgccgccctgcctcttgctggtctgacagcatggcgtgctgtattcaccaagggacaggtccgcgaaggtcagaacgtccttattaccggaattggtaagcaacctcgaaaagataatcgatggacaaaaagaaaaagtgcacccatggaaacggcagaaggtagaacccgaaccagcgcatttatcgtcctcttctgaatggctatccgataggcggaggtgttgctctgatgactctgttgttctgtgttgctgctggcgccaatgtttatgtcaactcgtcggacgacgacaagatccgcaaggctatcgagcttggtgctcggggaggtgtcaactacaaatcaggtaccgtgcgacctacatgtacatacgtctgcctttgtgtcattttgaatttctgtgatttattatgcccctctaacgctcctatcttctaatttattgacattcactatatagacaagtggatttcccaacttcaagacatgactcatggcgaaccctttgacgtagtcattgatggtgctggaggtccggccttcaaggccttcgctaatcttcttcgccagggaggcatcattgtctcctacggaatgaccgttaacttcgcggtcgactacgacatgattgctgtcttgcgcaacgtcgaagtccgtggaagcaccatggtgagtccttgttgtcttatggagcagtcatcacaatcttcagcgaagcaagcatataatatagcgatgttcaatatcattagctaacatgaacaactgtttttttttctagggatcgcgcttcgagtttggcgagatggttgactttgttgggaagcacaagatcaagcctgtggtcagccatgtctggtctggccttgagtctgctgaagaggcgttcaatgtcatcaaggctggagcccagtttggcaaggtggttttgaccttgaagagcgattcccagctgtaagatacatgcaactacttatgagtgccttggatagaatgaccactgaatcaaaataaaaccacgcgctattcacaatctaactgacgaaggtaactgcgccatcgcaacatggcgttgcgaccgccggtgtcaataggtcccatatgatacgctcgaagatttgactcgttgatgttttctttgtgccccagtttcaagcccactttcaattatactttcagtagcgttcaacaagtcgctgggctcttctatgttcgcttcttttctacgaaaaagaaaaaaaaaaaaaaaaaaaaaaaaaactgtccccttttcctgcctctcttccaaagaccagtcctcataaattgacatgaaagtcaatgtgtgtacccagtcatttcgaaaaaaaaaaaaaaaaaaaaaaaacagcgctttcctcgcaaaccactattcccaggcattttttttgcatccagaggcttaacacgagttttgttggaaccatccaaggcgggcatgggccatggacacgtattgttgctacggagacaaaacgctaaaaaaaaactatgtacaaatctacatccaactgcccacttgcaaaggatttgcgctcacgctcgcggtggccaccgacgtcgttgggggcgaaagtgcagccgacacgggcgtggtcaaggcttcaccggtgtgacacgcgataggactaccgctgctggtattcacagaaccaccgctgctattgagtatcgcatcctgctctcgctccacagtcggcgacggctcacaggggtgtagatacgtcgcaaacacctcctgaggaggatggaacacatgctccgatgcttgatctggctgcagatgctgtagttgctgctgcagctggacatactgaacgtgctgtatatgctgctgctgttgttgttgctgttgttgttgttgttgttgttgctgttgtagctgttgttgtagctgaaactgatcatgctgttcctgctgctgctgttgctgtttctgatactgcctctgggaatccgcttggcctcccgaaacaatgttcttgagcgaggaacagaatcgcccgccactgctgctgctgctgctgctgctgctgctatggccactgctgccattgacgccaatagcaggggccgaaagtccctgcgcagcatagatcgaaggcggatggatgatgtgctcgttgatcgcaaagctcatactgttgacggctgcagaggccacagcgaccgctgctgccgctgcacctgctgccatggccgcaataggtctggacatgccaggtgatattgtactaccaccgtcctcggagggcgacagcataagcgcagcattcgagggcggagtatcaaagacgggactagaggtcacaatcaacggagatgacatcaaaccgtggtcttggttttgaccaaagtaactggcagacaacgacgtagacgagctcgacttccccatcgaaagcggtgcactcctcagctgcgactgagatccatgactcttgaatcccgcatggctgttgctgtactgcattggctgtgatccaggcgtggagaacccacctaatgagaccgctggcttgatactgcctccgccaccaacgcgggagctttcatcctgcaacgtgttttcccgaatcaaggccaaccctcgcaaggctgcgggtgaaagttccagttcgcgtttcaaggccggtgccttaccgtccgcactacctccggcagctccacattccagcgtggacgaggacgtgcaagactgcaatggtcccaggttagagtggttgcatccgatcggagcagagacatgccccgccgacaccatagcctctaccgtcgaagtgaccaccacactctgggccgatccaaggctacccatcacagctccctcgggtggaggatcatacgactgtgtgctggcctccgcgtcgcccaggacgcaatagtttcggaccatggccactagatccttttgcatcaatggcttggtcacataccgctccatgccagaattaaggcacgccttacgggctgtttcctggatgtcagccgacacagctacaatgggcaatcgcgggacaggacccttcacctctgccgcatgttccttctccaaagctctaatctgctgtgtcgcacggacgccgtcgcctagagaggagtgatcaaacatggaatgatgagtatacgaaatcctgtggttccccttttgcggcggtgtcgtgaaatggaggatatcccatgcacttacagtttggcatatgatggtcaaagaaacccatggtgtagtatcctcgggggtgcgccttgaagagggctagagcatcagcaccatcatttgcgcaggatatgacaagaccgaatatagcgagctgctttgaaaggaccttttgcgcaatcagattgtctaaaaataaaaaataaaataaaagatgacttatggttaagcactactcaccctgcacgcaaagaagacgtgaaaggaactctttgctttttcatgtttttttaccttcggccaacagaatacgcatgccttcgatacgcttggcttcctcatgcgacagcgagaactcgctggcttcctccgtcaccagcttggacgtcttgcccggctttggggaattcgagcgcaactttccgttccttgcggtcgaattagacagggactttttcttgaacgtcgttttgcccgtcgccttttccttcccggacttcttctccacagcatcaacaggatcaagggtctcctgcgcaccattcacagcaccggtctttggctctacacccgtcgtcggaagcggtgaaggcgactcgctcaaggccatcctctcctgctccgcgatggggggcacaggagtcattccgcgctcaataaccaacacttcctcgagttccatagcgccctgtgtcgtttggtcaacgtctccaccatcggctgtgatcgggatcacgtcgctgccaggaaatgaaatctccagaggggttgggtccattgtcaatgtcaacattcctgcctctgcaaaactctgagtgatcgacttttgctcctggggcgtcgttaaaagatgattcgcactgtcaacactgaacagctctggtcgcgcggctaaagtctgctcctcctcctttgaatgtgcagtctccttggcaagtaaagcaccctccagtgtcgataccacagaagtcgacgcgctacgcgtcatgccaatgggcgacagtaagacgggcgatccaagcgagtgagcgggcgaggatggcgtaggagacagtggactgcctgctgcgggcgcgctcttgggtggcgcgatagaaaccgtggggctggagggtgcagcagcagtagagccattgctgacaactcccttgtgggcatcgtggatcttggcggaatcatccaagatctccacaaaggcgcgcagcagcttgaggcgtcgaagcggtttggaaatgcaagtgatgcgcaagctgttgagcttttcggggctcagtccaggcacctcactttgcgccaccaatcctgcagagccattcatgccgccaccagacccgctgtggtccagccgaagcgaaaccgactggctcaacatgggtcttttccgcccgccccctaggggggacccagaggacggtgtgctatacgacggtggtagctgaagagattgggcgcgtcggatgatgtcggtcgatggtgtgtacaagagcacaaagtgcacattgttcaaattcggccgcgcctgtaaatccaacatgatggtatgctgcggatcgtgcgccggaaagtcccagcagacaaagtcgaagcggattccgttggcgaccgactcttctagacgactggaggcggtcgatggcaagttggcgacctcggtgttaaaatccgacaggtaggcctggagggttgagatagtcgtttcgctggtagaggcgatcaaaatccgaggtgttcctaatgtgcgagtgatgcgcttgatttccttggtcgagtccacgacttccgcatctgcggttgtgcgcaacgggctctcgatcgccatgttctgctcacattggataacgaaccaaaacgtcgaccctttctcccgctgagagaccagaccgatgcgacccttcatgagcttgactagctggagacagatggagagtccgagtcccgaaccgccatacgaccgcgtggcacttccatcgacctgagagaatggcgagaacagaacctcttgttcctccgtactgatcccgatgccagtgtcctcgacagagaacatgagtttgatcgagttctcgctcagaggctccggcgatgaaaaccgtccagagttgggtggccgcatctcggactgacattgacccccaccgttcttctcgtgcctaaagtaaaacttgtcgtcatcgatgcactcctccatggacgagcccttcgagaccgtcgacatgtcagattccctgtcgagcaccttacagcgcacaatgacatgtcccgagtgtgtaaatttgatggcatttccgaccaggttgaggaggatctgcttcagtcggttgcagtcaccgacgaggacctcaggcacattgtctgctttgataaacgcgagctcaagagccttttgagacgccagtggctcgacaatatcctccacctcatcaaagacctcctccagatcaaatggcgatgcctccaaaatcaccttgtctgcctccagctttgaaaaatccagcaagtcgtcaataatgagcagcagcttttcgcaactggctttggcggtgtacacaaattctttttgctcctcgtccaggtccgaatatcccagtaacgtcaacatgccgtggaatcccgagaatggtctgtcgaaaagcaagaaatacaaagtctttgttaattaacctacacaagaccgcaatcattctcatcgcgccactactcactaagagcagcaacgactggtacttacgtccgcagttcgtggctcatattggcgagaaagttggactttttgtggagctcagccttttgtgccaaatacaggtcatctggaaaaaggagttacatgtcaagtcagaaaacgatctttttctgtaatatacacatacactgtgagctctatccatgccttttgccttaccgatatcaatagtcactccgacccacttcaagatggctccactatggttcaggactgggatcgcacgggacaaatgccagcggtagacaccatcatagcgcatcagtctgaactcgcagtctttataaactccagtcttgtagctttgtgacacctccttctgaaagccagcgacatcatcaggactatcagcataaaaaatatgtcagttcattagaatcgcgccccttgcttcaccgcatgaaaaacaagcaggttgccctccccaacttactgcatagcgctgatccagcggtcccctgttcgattatcgccaggcagacccgtaaagtcaaaccaagaccttgagagatagcgacggcttataactacggtagttatgagaaaaatgtgtgcgtgagcgggttgatattttcctgatggctcgcatgttcaaaggacagaacacacaaagggtgcatggaatacgaaccgtcatcacgctctgcgacccaaacaaaacacggcagcgcctccatccacgaaaagacttcgtgttcattctaagtttgttgaagaagtcgtgttaaaagagtaaagtcgttataaagaggttttgtggacaatgtgatgacctggtcaagtctgcgagtcaaccaataccttttggatccttgcaatggtgtcctccaggaaccgattgcgttgagtagctaacaacaactgcttctccacgcccgcaatcttttcacaatgcagtaatgggttggcgagtctttgacaaaacagcatcagcagttcctggtcccgtttcgtgaaatagaaccgtgggtgaagatggtgcaaataaagtgctcccaccagtgttgagggcacagtcactccattacttcccgactgcatcaacgtcgtcagaatagggacacatgcgatcgtaggaagctgagaacgactgccgactgctgttgaaaagacgggctcttgcgtgtccaatgccttccggactaatactggcatgtgatcccgtctttcagaaagatctgtccatgtcaaggttgcctgcttggtcccaggtcggaacttgtcctctataatggcccatgtgcccccattgggcgcatgctcgtcctttttccataaaatgatcgccatctcctctggcggatgtccggcaagaatattgtccaaagcgtgggagatggcgtggagcatttcctgaagattcgtgatttggctgagagacagaactgattccagaacgaatgcgcggtcttcgaaggaaaggttttcaaaactgtgcgggttcgtcgtggggcgccttgtcgtttgagagtttgcttccggttcctggctggccagggttgaagtcgactttagcgagtgcatcgaattcgcgggtgacgacgatcgtggtataatggaagaggtgtaggaggatgacggagtgtggaccgtgtgtgttgaccgcgcagcactggggtttgatgaccaaggatcagggtatcccttggacgaggcctagatcatgaatggtgagatagatggcgatgattagttaactggactatatatcaatgttccagtgcgcatttgacaggacagcactttcaagacacaccttggtctccgcttccttgagtgcctcctgttcgtggtctctaatgagcgacaactccttcctgatctgaatcatgctaaggaatcgatccttgtagctctattcaggcaaagaggaacactgaatgagacattgatgtacggtacgcatatacatgcatacacctgcgcaaactgagctgagcaaaaattgaccccttggataatcaattaccttcgcaaccatcctctgaatcacgccggccacgcgcgcataggtccctggcaagcatgcacccgtcgcagcggttgaagtcccatatccagttgccatagtgttcagtccctctgtaatggatcccggcgtcatctcctcgggcagaagcgtcgcgtgcgacgtgagcaggtagtagaacatgacacctgttcagcaaattcagttagtcgaaaacagagagagaaatttaataagaaaatgtgccaatgcgatacgaataaggttccttgtggccagtcagcacaccaaccaggagccttcaatttgtcaaaaattgaagcacaaacatgcttaccaagggcatagatgtcgatctgtacgggcagcacgcagcccgcgggcgaatgcaactcctggaaaattaaagcaccggacagagaagcgatcgctgttaatatcagcctacaatgtactcgcgttggatttgttgctcacaacccgacactccctccctttgcatacacatggctgcatggttgtttcagggtatacatagtctactctcccttccccgccagccgagatccacccaaaactccaaaaactccgccagtacagcaacacagtaaccagggcagctctctgctctgtcccgtccgtggtgtccgtggtgtccgtgttaattgttgggctgaagaaaaagcccctccaaattggcgtggtccaggcacaggtgtagcggtccgaggcacaagggggagggggaggggggcagaaagggaggccatgcacaatgaacgcaaagggaaaatgcaactgccacacgtcaatatcactcccgtgccaggatagaggcttgaagacaggagggctggtatgacaatgatatgaaaaaaggagaaggaggaaggtctacttgcgcccacgtttcctttttttctcgttttttgtcttttacctgtggtacatgcagtaagaagtgttgtttcagaaccgactgttgggttgacccgttcgtggctggagatgatgatgataacgtcgagggtgtggcagagggtgaagtcgagagtagagatgcggatgtagaggagctctgaccaagcgctggcgaggacgcggaagaggaggaagggaggaacgaccgtttgagccgttgaacgcgtgtcgcaatggcatcgtggatgactgcagcgtggttgttggagctgtacggcttggactctggcggcaagaacaaggctgggtcgagcaacgtgcccgcagcggaatgactgggacggttggtctcggaagatgctctgccgtgggcggtagcagagggcgaacggcttcggtggttcgatgcaggctggctgaggtcacgaagacccttccgcgctgggctgtgtgctggctctgagctcttctcgccaagaccaaggtgagtgcagtccaggaccaacgaatgccgcctctgccgtcgggtcgtcctgcagctggtatggctgttgctgttgctggtgcttgtggaatgaatgatgttgttaccgctgccgttgaaggactggtagtgtgtggtctttgcaagcgagcctgcgctgtcgagcgtcagctggctgggactggtgtggttgtcctttcgcacagggtggctctggtagctgtgtctgggtgaggagggtgcgccattggctctggaggcagtggggatgatgggatcgaggtccgaggtggagcgcgtgtctgtagtggactgaggaggctggagagtcgaggacgcctcccagcggaacgaatttgggccaagctggccgtggatgagaccattttggtgcagggtctcgagcaagaccgcggcctcgatagcaaattccaagaactgactcatgttgaagttgtactgctgctgaggtagctgctgctgctgttgctgttgctgttgctggtgctggtgctggtgttggtgctggtgggcctggaggcggtgctgtgatgatgatgagggtgaggaggcagacgatgatacgaaggaggaggataaggacggcggtgatgatcctttgagggtcgtgttcgttccagtgtcgctgtggtcgtggtcgtggtcgccagcgcggtcgggcatcagcagcggctgcaggtgctctggcgagagtgcaggctggctgtgcgagcgcgcatggtgggcggggtatgctgggtatgtagggtaggcggggtaggctggcggatgtgtgctgtcctcgtggtcgctgtaggtgatggacggtctatggcgcgcgagggcgtcgcctggctgtgacatggtgtggcaggagcagtgggtggtgggaacgagggcgtggtcacggggcgaaggaggcgaatgtgtgctggaacgagacgacggggcaagtgcaggcaagtgcaggcaaatgacagtgcacgggtgatgatgactgatgatgacagacaagaagaaagagagattgggatggcaatgacacaacaggaaaaagaacgatggggaacgagttaaaagagagcgagaaagagagaaaacaaaaacaggtgagagaaataaaacaagagaaaaaaaaactgttgatatgaaaagagagagggtgtgcccaagggagcgtctggaaggaccaacaggcgaaggtctctcttctgtatcttctgttgggcgctgttcgtgatgtcgggtcccccttgtctgcacgctgcatggcccatccgtcctgggtttgtggtgtgtgcgagctgtccccgcctatgtctctctcgcgagccgacacgacaacggactgtgggagatacattccctcatctccatccacacacccttgcgcgttggaggaggggaaaagggactgtactcgttctgcaacaagatgcccgatccatacaaccctgcggatactcagttgcatgcatgcagacgactgcatcgtcaatggcccatcgacaccatctctcctttcccctccctcaccctccattggatgcaggagcacttggcccccctcatcgaccactctcatctcatacgctatctctcaatccgatttgtggctatcttgcaactcgcacaaagatatgctgacgatacttgcacacaaactctctctatctgtctctctctctcgcgttgcattacacggtttacatcccttggccgatgctgtacccaaacagaattgaccccttgtacggtactctgtttttatgtttctttccccgatcggagatcccagcatggggactgagagcgcaaaagaacctttttgttgttgttgtcctcgacaaagtcgtcataattattctgtaatgctgcgttctaacggacatatgaaacttcgaaactcgacgaggtagcaagttgactatggaatgagatgcgccaaacgcagtctaggagtctagacgtggagaaaaccacgtttttgcgttttcgttttttcttttttcaaaaagggctagtgctgctcttttctatccacggtaacaattttttatttccctctttctaatcgcccgatcttagtgcccgagatctggctaatgcggcacacaaaatgacggaaaacatcaaacctacgtcccaggaacaggaacgaattggggaaaaagtgcgaaattgcgctaaaagaaacaaaaaaaagtcgatctcgtcactttccgtgcctggacctgtaacgttgtctaccagcagggttcacagactcactttattcctccttgataggaaaaacaagcaagtgaaaaaactgctcatgtggacatccattgtcgcacagtctctactacaccgttctcgatgaacgctcgctggaaggctcgatactggacatacaattgccgttcctcaggctggctgagccggctctgaactgcatcctgcacaacctcatactgctgactggagccatcctcatagtccctcacaccctcggtagccatcacggccgcagtcagcagatcaaattgaccctcggatacagcaggccttgttgagtgttgagtctcttccagcttagaattgtcgggtctggatgaacatgcaaaacaccacccatttgattagcgggcgacagagactgcaaataaaaagcggggacttttttgcatcttgctcacctttggcaccgcttgacgaatccccgcaagatcattgcttctggtactctgtagatacctccacctatgcgttgggtaaaccgtgacgtaaacgggtacactgcatgcaattcagtcgcgtcgtccatgatctcgatgtcgccgtcgttgaacgcaaaggggtctgagacgtcaatcgccactgcgtctcttttcttcctgcgcttgggctagtggcaaaaatatgaatacggcatcacataagtgcgtgcgagcataccctcccagttgcgggcattgatggggtagtgtcctctttgtacgcaggcaattgccaaccaaatgacgacatagtatgaactatttttcacttttgtgagagcaaggggtgtgagaacaatacttaccatgacggggtcaacatgattcggacacatccaacgacggtttcggggcggaggggacgccatcggcggattaagacaatccaggtgccagtgcaagggacagtgatcgcagctaatcatcatcctgccaccgaacgcgctcctgttgcattggaaacagtatcgagtgcgaccatatctatccagcatctggagtgactcctcgcttgcgagcgatgtgtgcgaggatgacgatgtcgtgggagtatttttcagagtaggtttgtagtcttgtgtatccacatatcccccgtcgctgttcgtttcgactggtatatcagagagaaggcaagaggaggaaggtttttttttagttctaattacgctctaatgttgcattgggacgttcactggacggtttaaacgtcgcacacaaattatacctcctttgaaataggatcgtatctcttcagggagctcgaatgatcgtgggttcattccatcaatatggtcgagcagattcttgaatattccttctggattggtcattggagggttctaaatccggaaggagatttgagcatggtcgtgttacaagtccagccgaggaagagaaggatcaaacgatggattgaggggccaatttctgtctctacttaccaatcgggctcggcactcgttgcagttccactcgtccggaagattagctgggtccatgggtggattacagcacgaaaagtgaaatgctttcgggcaggtgtcacagcagatgaactggcccagtcccaggcacgtttcgcagtagtcattgttgtgctatcctttccaatagcaaggtcccacagcggcggtcagtacggtcttgcgtaacactagagcgaatggcgagcccacaaaacaagacaatgaagtatatctcgcatctagcactgccccttcctcgcttattcagcgcttcgtaccttgagcgcatactcgtctcctgtcacagacaccaggccctttgggaccatggccattctatcactggaacggaattaaaaaaaatgcatcaaaatccttttagagaaatagagagtaaacaacatgggacacgatgctaaaaatatccaagcgatcgttccatacctttctctgacaagagacaaccttggcgcaatcgacgtcagagactggtggccattcttgtgatcctgcaccttgggccgtttattccctcgaaagaccttctctgccgccttatcaggagagacactctcatcgtgcccaactggggtgatggtgtccactggatcctgctcgagtgaggttgatgtccttgtggccctgccccgcatcggggttggagagactgattttgaagatacccttctggtgcgcttttttgcggctaatggcggtgacgatgacggcgaggacgatgttgatgttgaggactgagctgacagtgacgctaccgctggtagtcgtatgacaagccttggtcctcggttgggaccgccttcctgtacaggctctgagggtgaggcgaggtctgagctgagggtctttgtcgctgaaggccagggcgatagacactttgaaggagagtcaaggtttggcgtattcgatgacgtttgctccgcccctgctgcagcctgcctgcggcctcctcgcctgcgcagttggatcatggctccgtgtccgccagagttctcggtgggtgaactaatgagcggtgctgaaattgctacggcgcaagagtcgtggttctgtggggatgacagtggtcctgcatcttggtgcggactggaggactggacggagctctgagatgtacaaaggaggcctttgttggtatgatcgccagatgagcctgctgcctctgaagagccgttgtggcctatacagcttcctgtcaccatattacaaggatgcgtcccttgcgaatgatgtgcgaggcgagttgacgctgagaaaggggcgggagataccagcgttgcttcaagagtcgaaggatgggggtcgttggtgcatctgacgcctgcttgatcctggcgcgggacgaagagctgtcctcccgatgttgcctgtgagagtcgcagagtgtctctgagtagggcgatcctgctagacgttggatccccgtatgtcctgtggtgcgttggaaggagggctggactgaggagagcgagagagagagaaagatcaaaaggaaagaagaggaaagaaacggattaggcctggattattttaattgagccaaaaattttttttttttttctatttcatttatcaatcactcactgtacagacagcgcaaaaaacggaaaatcacagggggacacccaaggcaggctggcttttgtatgagcctgcgatttgtctcatcctgtccgtcccgtccttcacagcggctaggccaccgatgagccttgcagcatgttgtcgccatggctttttcatagaaaagcatactggacccatagccatttccgccgctttggtcttttgcgtgcaccgcgcttgcggtctttacactttttttttgctgcttgcacgtcaacgaccactgccaggtgtgcattcacaggtttgttcacgagaacctcttcgcctgctgctggacagtcgttttaatccccttgggttcggcacatttgatccgcctaagagcaagaattaccaaggaatcgaccaagaattcgatctcacacacgagatgcaaatcgatggacgtgctatgcgcgatgtgcgatgggccatatcaggagctacctcaacaacttgcgccttgcctgcgtgatttttggcccgccaatggagcctggcgcagctgcgaagagtactacttgacaggcggtcgcacgaccagagctgttgtgcgaacgcaagggagtcgaatttgtgatctaggcatcgatggacattcagcctgtttttgactgctaaaatgtgggccaattttcgctgtctgtctgctccccagcgtccccgttgtctctgttgatgcagaatccacattggcttttgtccattcagtcctcctctcgctattcattcgtatctgtcagtctgagcattcgcgagctgatccaccccccactggcccgaccaacacccctgctccgcgctcgcagcccattcctctcgcccgacagccacgcaccagctgcacgcgcacaatgtcggtggagatttaccgggccaaggtgacaggtaacaaacaaacgagcgacccatccacgctgcagtcttcgcctttaccctcttgctgcaatgcatcgtcttccacctgcaggacaaggacacaaaggaaacatagactgtcgcgctcttcacgctcctgcagggccaagtgtcagcagagggctttcgcgccggctcgattctctgacaccaccacctcttgcattcgcattgcccacacgctgcacggtgaaaaaactgcacacctctgaaaaaagtctcactgaccgatctgtttgttatatctctgcctcccctctctcttgctccctctctctctctctacctctctctcgttctatccgttgctaacttgaccttgtagagctcatctcccaggcggatatcacaacagtatctgcacgcaaaattcggaagcagatcgaagccttcaccaactctagtctcgaccatgtcaagcgtgattttgacgatatggtcatggagatctatgaaaagatcacggacgatgtaagtagagactcccttgagcgcgaggtcaccacagtcttttttttttttgtccatgatcaaggacgcccattttttacgataccatcactgagagactgactgactgactttttttctaatcaatacatgccacattgtacatgactctatagatcgaacgttctgttttgaatggcactacggcgcccggcgctcaaccaccaccacaacatcatcatcctcatcaaccccatcagccgcatcagcagcagcagcagcagcaacaacagcaacagcagcaacagcagccgcagaccggatttgtatcaggatttgcgcttccgcccacatcgtacgtgccacctccacctccgcgcgtagccgcccctgcacctgcccctgcaccgagcaccagtgacgagtccgaagacgacgacagcgacagcgacgcctctgaggcctcgtactcgtctctggacgaggaaacaggacggaaacgaaagaagccgcaactggtgaaggacaaggctgcgaaagcacagtcgaaaaagaagaagacggaagcgcaagccaagaccaagaaactcaaggacaagggcaagaaggacaagaagaaggcggaggaaaaggccaaaccaaaagtcaagaggaagcaggctgtgaatgaggatggcacgcccaaagtgaatccgttcaatcggcccatggtcatcagtgacaaactggccgaagtgattggacaggctgggtcaataggcccctcgggacggattgaggtaagaaacaatgccatggcaaagaatgataggagatatgagggggttttttttatttctttgtatccttttctaacatggtgtcattttgccccgttattgtgatactcgttatagatgtcgcgcccagaagtggtcaagcagctgtgggtttacatcaaggccaactcccttcaacttgaaaatggtaagagatgcaggagctggcgctggcagcacacatggacaaacaactcgggaggtggaacattggaaaacatgctcaaagtcttgttctctattgaccttctgcgcatagacaaacgcgtcattgcttgcgacgagaaactgaagacgctctttggacaggaacaggtcaactgcttttcgatgaacaagtacctgagcaatcacctgtcgaaggccgaagaactggtttaaggacgagagagagcgcgagagccaagtgcgatgcagcatgtgtgcaggggagggaggaacggtagagtagggaaaaaaatactaatggctttttcttcggtttttctggaagaaccagcctggcgacatttttttttttgttttattattcaagtaattcaagtagttgtcatcctcgaattttgatacatcgctatgaccctgttgataaagagcaaatccagaggatcataggagtagaagaaaccctcatagtccccatgcgtgtgtttcgacttgcttttattgtattttttttttctgcgtcaaaggtgtcgcaaagccagtgtctgagggctcaagcgttccagggactgggtggctcatacactggcgagttccagggcgaatggccatccactgcttctgcaaaggcgctcctaccactctgttcccacgtataatcaccctcataatggcctgctgcaccggctccagagccccactggctagtctgcttgtcattctcatccacacgctctgatccgttgtcaccgtccagatcgtctacgccctgataaccatccatatactgctcctcttcaccgctgctgctgttactcccgctatcgcgcccatccagatcaccctccagagtggcgcctctgaaatacagtcgatcatatcgctcatccgactccttccaaaacggatccccctcgtcgaacgtaatcttatcctggtccaaatccactgtaaatagcggagtctgctccagcattccaatcatcccgcgtttggtcttcagtcgctgtctcacggtcagatccgaccagatatcgtccaacgccagcacgcccagttcaatctcgggttcaggagtggcctgcacccctccatcgcctttgctttccatctctgcttcgcctcgaacagtccgatcctcggtgtacccattgtacccataagagtactcatcctcgaccaccggccgcggcggaagcggtcgtatccgcgctattttatcctgcagaaacgcccggttatcgtcctccgtatgcgtctctgaatagacagggtatacgatcttggaacaaagggtatagcaaccccacttgggttctgactgcgctcgttgatctggatgtccgtccttgaggatcgcaaactgagtgcagtggcccactgccacatccgagttcggcaggatcccaacgcccgtgaacgatgcactgtatccgtattcgtctgcagcggcagtacacctgaggaagtggggaaaaaacgagatgactcttgatgagcggagaagaagaaaacatcaagagcatagcgtgtgtgtttacgaaaagatacgaaaaagtttgcgtgctagctgggtcggggctgcttaccattgctcaaactcttgtcgcgtccattcaaaccgatggtcatcgttcctcaggatcgcgtcgggcgtgccgtacttgagttgaggaaagtacacgttgaactctgcattcggtgtggacacgatcacgaccttgggtttataaacgccaagaacgacgctccagaatttctccagcacttcaggatccaaatgctcgacacttcaaacagggagtaaaaggcggtggcggggaccccgtcgaaaggattcaaagaaaaggaaaaaaaaaaaaaaaggcgaagtgtgggtttcttcagttctcctcaagtcgacatggttttgtggaagcaggcattaaaaaaacacacattgcgattcaaaaaaaaatgactccctcgcgttacttacacctcgagacaggccagcgcatcatatcccatcaatcgactgtcagattcagccacagatccttgatagagctcgatgatcaggttattgacacgcaagttctgccccaactcaaactcttgtggctgacagtcgttcgccgccagctcgagtcggtctttgctgatgtccacacctgcgagccgcgtgatcggaaagtcgcccatggattcggacacgagaaccgacgtcaacgcagcctccccgcacccaaagtctatcacctaggcaaggtttggaagatgagagagagagagagtatgcgtgtaaaaagtgcgaggaccgtgagcgataatgaggtgtgtgtgtttgaagaaagagagtgggtttgtcagtggacgcgttcgttagtaaggttatgggttgttgaatcgttcgatagcttttgtcaagtgtctggatttttccttctttcgctgttaccgatgtcgcgtggttctcttcaaggatgcgccgagcaagcgtccggcgctgctgccagagcggaggaaagaaagtggcctcctcagcctgctcgccagcagctggaccgagtgatggggaatccgacgacgtggacagggtctcctccatgcctgcaaacccaaaaaggtcgaatcaggaaaagatgtgcagcttgcggaatgcgtatacaatggagatccagaggcgtgcgtgtgtacggctagcgtgcgtagcgtggagtgcgtgaaggaaagcggaaacaaaaaagagaccaacagtaggcgagcaaaggaggaaaggacagaaaaagcaaaaaacggtgatcgatcgcttgctcgcttgtacgacatgggccagaagagcaaaaagggctcaaaaaagaatcgcgtcaacagcaggatttgaacctgcgcgggagaacccatgagatttctagtctcacgccttaaccgctcggccatgttgacatttgatcataaaaataagactgcttggtttaatatggacctatgaataccttccacgtacaaactggtgcaacgtcacggtatagtggcgctcgcacgtactgctctagtggttcaaggaacgcccagtaaatcacgttcacagatgcgtggttggtttagtggtataattaccgcctgccacgcggtagacccgggttcgattcccggaccacgcaaatatcttttgctgacagttccctgatgacgacgaaatcatcctcacttttttctcgcgcgcgcttcttgttgttcctgagaaatgaagatctctgtttttaggtcagtcctgtgcctgtgcctgtgccttacaagcttgagcttgacatccaggggggcaaatacgagaaaagtgcacaaggatacgttggctcagctaggagtcgactcttcctatgcagcagagtcgagaaacgattccgccgaaacctttttgttttttttttggctgcctgtctgctcgcgcttttgcacagccgacaggcccgagggtataggtgtgagtgtgtgtatgtagtatgtgaatccccatacgaggcagacatatggaggaatggggggtgtcataggacaccctacggtagggtcgagcagagggacaacaaaaaatcaatatccccagatgtatcgacagcccatctttcgtatttctgtactgcacctctctcccacccccccccccccctctcccatttgtcatctctcttctctctttctttctgtctcctcatccgtctctctccatcacgccatcgcttgcggtttccatcgtccttgcagtccatccctcgtgcccctgctcaagcaactcccttctccaccggggcaccgttctttctctctctctctctcacacacaccacatccctcaccaacacagctgtctgaatgaactacggacaaggcggcggctaccccggccagcagaacccctacggcggaggctacgatccctcggtctacccgccccagcagcagcagcagcaggactacgccaaccagggctatgaccccagtgccacccagggctacgaccccaacgccagccagggctacgaccccaactacaatgggccctcggtcagtgctcccccgtactctgcatacccgcccgccgcaggcatgatgggcggccctgccaacaacaacatcaacggtggatacccagccagtcctgccttcaacaatatgcatctcaacaccagcaacagcatgaacaacggcggtggcatgaacaacaacaacaactatcccaacgggaacatcaacgcaggcggcatgggaggtggccccaccaacaacggtggatatgacaacaacctgaacaacctgagcaacagcatgaacaacatgaacatgaacaacaatggcatcaacaacaacaacatgaacaacatgaacaatggcatcaacagcaacaacggcaccgtcaactacggcccgcctcctgccaatcagcagtaccagtccggcggactaacctaccagcagaccatctacaacccatcgcccgccaagcctgcaggcatgtcgccgtcatcctccaatcctcccacgcccggtcagcccggtcagcccagtcgagcacaggcaccccagcccgagggcgactacccagtcgtgatggccattgactttggtaaaacccgcgtctttgacacgacaccgcttcacccgctgagcttttttttttctttctaatactcgttttttcttgctcccgtgcgcaaacacacactcaatcgacaggaaccacgttctcgggcgtggcctatgctctcaaggcagacggcgaagtgcatgacatgactaagtggtacgcgctccttctctctctttcactcttcgttgtctcctttgcacctctcctctcgtcgttcgcgttcccgcctctagaagaatgctgtgccgatgtctggatggcttgccgtctatcagtgcagcttgcacgactgctgtgccacatgttccatccaccccaaacatccctttttcactaaccattgaccaatgaccgtcgtgtccttacgctttgtccccgcctaggcccagacatctggcacaataccccaagacccccacgctcagcttgtacaagaaggactcgcaaaagatcctggactggggccatgcagcccgtctggccatgctcaagccctctgccaaggactacacgctcctgcgaaagttcaagctgcagctggacgaaaccctgcagagtgcacctctcgagaatggcatcacagctctcgaggccgtcacgcactacctcaagaagctgcacggacacgtcatgtctgagctcatgaagggcttcatcaagagctacgagccgactcagttccagtactgtttgaccgtgcccgccatgtggtccgacgccgctaagaataccatgcgacgggctgccatcggcgctgggctcatcaatgagggagacccacccaaccgcctgatccttatttcggaaccagaggccgcagccatgtactgtgagaggatggtcgaccgcttttcgctcaagcacggagatcggttcatgatttgcgatgccggtggtggaactgtggatctgatcgtctttgaggtcaacgagcccccaggcaagacccgccatttgcgcgaggtcacccgaggccatggagcatcttgtggatccgtgtttctggacgccaacatggagagactgctcgagcgcaagttccgcagataccgtaagggtatcaaggcctgcggatgggcctcgctcatggacacgtttgtggacatggtcaagcccatgttcaatggtcaggaggacgtgctcatgcagattccccaggctacaggtctcgaggacttgaacgaccccgagattggtctggaggagggtgttctttgcgtgccagtggaagaaatgaagtcggaggtctttgagcccgtgatctcggatgtgttggatcttatccagaagcagcttcaccagagccagcagacatgctctgctatctttatggtcggtggattcggatcctcgcgttatctggaagagcgtgtccgtcaagagttttcgcacctcgttggactagtggccgtcccacaacgacccgagttggctgtggttcgtggagcggtgtatgcgggactgaacaccaagacaatcaacatgcgtgtcgcccgtcggtggtacggtgtggatgccaacatgccgttcgaggagggcgttgacccggaatcgaaaaagatcatctcgcacgacggccatgtgcgctgcaaggagcgtttctcagtctatgtgcgtcctggtcagcagattggtgtggacgagtgtgtctcgaaggagtatgtgacctggtcctatcccaagggtctggattcgccactgtatgtgtgcaactcgcccacgcagccaaagtacatcacggatccgggcgtccaaaagattgccgatttccatattcccatgcccgagatccctggtgctcaaccccgtacccgtgtcgtctttaggctgaacatgtatttcggtaagcacatgtccttcctcccctttttcatattatgttgttttcgctttgagaatatgctgttggtgatttctcaaccattgtgtcgtttattttcatccgatagggttgaccgaggtgcgtgcagaggctgtgatcaatgggaacacctacacgacgatttgctcctttggcggcggaggcggcgggcaacgctaaaaaaaaaaaaaaggacatggattgtagcaaggaggaccatgcggaagaaattgagtaaaatagtcaagttttgtgtgtaatttcttcgttagctgctttgcctctctgagtatgctttttatatatatatgtcagaaaggccagttcattcccatctttgaggtagagtcacaatccttttctatttcttcggtaaaggagggtaaaaaaagttgggatacgatggtttcttgaaagagaacctaacccctgtccgtggtttgacatgagactcaattcataggaagggcagtgtaaaaaaaaaaaaaaaaaaaaaaaaaaaagtttgcgaaacagctatgttaaggcctttcagggcgcggcgttccccaaggaatgatagcagctttgttgttgtcactacaaaatttcatcgttcaagacgctggtctacattgtcttgatccgtcattcgcttccaaaaaactctgctcacttcagcttgtatttttttttcctcataaacttgaatcacaatcgcgtcgcactcgcgctgcgcacatattgctgaaaatgaaagcggcctaacgggttgtaagattagaaagaaggtttgctggaatgctcttcacgaactcgacgagaatactgttgtttttctgctacaatgccttcttgtctaaagtttaagttgtcatacatgattgctgaagagggtcctgtagatccaatggatgatttcgttcatgatacggtaagaacacgcctcttcttggattagatcaccaacgcgtcgaatcgcgtcgagctcaccatatcgttggcgcagcgtatcgaaagtgtttttctatacaaaaatggtatgaatatgcaaggattctgaagtccgcatgtcgccgctagctgtgttttttcccaactactgtatcgtgtggttatcttttttaccaggcaacttctctcaattcttgctccctcctcaattcttcctccacctcttcctccacctcgcgccttcgcttctcgtcccatctccgtctctccctctctttggcttcctgctcttgcttcattgccctctccatctcccgtcgtttctcttccagctccagtctcagcctctcctgtctctccagccgttccttttcttcgcgttccagcctctctttcactctcttctccttctcttccttctcaatcaactcaaagatgggctgcatctgctgtcgctgatacgggttgggctcacccgcctgtcgattcacatgccagagctgagggggtcgctgactgggggtcatgaaaatgtgctgcatcggcaatgcctcctcgatagccggatagtgcttttgaagcactggaaccctctttcgacggacgactggagtgatctggagaggagtcaacgaaaaagaggtcgaggccgcggcagaggccaataatgtgccacagtccagaacgaccgtgggtcttgtcgtgatcggagcctgttgtgctagctctggaatctgtacgagagcagcccccttgttgacccaatgcgcaagatattcacactggcctcgagtcatgtgggtgccgtagctgaggggggagatgaggttcgagatggatgtgatgatgagaatcaggacgagaaggagactgaactggtgcctgcgcgatacgaacgcgtcaaggaggctggagagtacggcagaggagacaaggacagcgcagtagagggctggatagtacaaatctagagtggagctgctgatgcggtgggtttttggaagcagtgggaagagaagaggcagggcgtggatcgcccaggctgcaaagattggagtggaagcggagagtcgctgcttcatcatggctatcgtttttttaaaagaatgatcaaagtggaaaagtagacgtgagttgataatcccctgatatagctgctgttctttctcctccgagaaacacttacccagcaaggacccctcctccatgcagccaagcaggccgccgagcagaaacaagacttgcagtccagcgaatacagccagccccagtgtgcttgtccaccataccgcagggttggctacaactgaattctgctgcatcgtgctcccatccttgctgtccttgacgacctccggctcctccttggcctcctgtacatctcgaacatcatggctcctactcctccacagagtacgtgcagatgtggagcccatcatcagggaccagaggctgggctgtgaatcagacggccacataaattcagacgctgcatctgctcgcggtctggtccacatgagcgtgtgtagttcggcaatcttttgaagtgtcgacaactcgggatacagcgccagagccgtgtctactggcactacgacaacacaagcagatacacatagaaaagaatgatgatcttcatgagttattgtctggagaaatgaacgtgacaagtgaagaaacgtatgcaaacgacgagcagccggtgcattacttacaatagtcatgttcgttcatggtgatacgccagacagtactctcctgcaagttctcgtcccgaacacaggaaagctctcttctacccgcgccccccagtacctcctctggcagctcgcgctcacttgtgtgcaagaagcatcccagaacatggtgcctcagccggaaagtcgtctccagcgccttgatccgcgaacctgtcctgccctgtacccccgggaacatccaatcgagaggcttgctttcgatgacctgaacagtccaccagtcctgaggaccgtcatcgccgtcatcgctgttgttgctattctgcttctcgctgctggatccagcttcgcccactgcgctcacttcgcaggacggatagcattcctttcggtcgatttggctccggggtatctcacggcgccgatcactcgtgctggggacgttgcgcgagtgcaggcatcggcgggtggaaacgtgccggagacggatgagatcgccatccttaaggtactgaagtctcgttgggatctcgttttcgcccttcctgaagcgcccgtcctgcttcgactttggattggtgagatgctcgatactggctcctcctttagcagctgcggcagaggccgaggtcatgttggcttggacaacgatccagagggtattcagatccgaatattcgtaaccagccacctgctggtaccggcgcgggtcccgatcgagtggatcgtcgtggactggcgcgacagcagagtgattccacatttgattgaacgagtgcaaaaacactgcaggacgggtctcgctttggagctggatgacggagccatagacgacgtcgctccaggcttgggttgggttttggtcctcgacatagggcgagagaagcgagtgtcggagggggtggctcaacaaggtcagatcgtagtcgccctgcgctgaggtgcggtagggcggctggtgggactgcaacgtgaggtggagcgaaaagagtacgacgtagagagcgaagggcaggatgaggagagccaggatccgcgagagaaagtgctttgaccactggggctagatgagtgtgcatcgtgtgtgtcggtatgtgtgtatgagcaagagagaagggtgagtggacgaacgagaaaaagagagaacgagagaagagagaaagcagagaaaagaaaaggatgtcagcatcggcatcactcacaccaagtagggagagctcaaggagccacattcagttggcgattacgcgttgttcggctctgctgcttgcttgccgcaccaggtcccatcctgccagcacagcgatcgtccccagggtgagcaagccatgggtcttggtcgccgatgctcctgccactgcgacgccagtcatcccaagccatgtccaccacagagcagtgaagggtctgtatgagaatgtcaaaggtagggacaaggcggggggtcagagccaccatcagtatgtgttctttgaaaagagttcgaaatgacagttcatccaatccaagagtccaggacaactgaccttgactcttgctcagtaaactttgcccacgccatcagggacagtgctgtaaagaacagtagtggcgcctccagagtcatcaagcgatggctggccatcaacgcgttgtctagaagacacagaccatccgcgtcaatgtgaatacaagagcgagttagagcgtggagtgagagacctgcagcttgagagtcaagagttgatcctaccaaagatgatcatgaatgcagccagaatggccgcaaacggagcctggccaagcgctcgtagggtcaggaaggccattggagcgcacagtgcacccatgctcgccacaaccgaccgcattgccatgtacggcagctcgctagggtaggtgctaaaagcaggaacgcgaagatcagtcctgcaaaagcttttctttaaaggtaatactgccttcattgcgaactgaataacttactcgctgacattgtcaaaaggaaacgtgcccgagtagtggccagcaatcttgctgatccctgccagaagcatcttgccgagcggtgggtgcgtatcaaagatgaactgcttggtcaggtacccgttgacgtacttgcctacatgcgcttcatcaactctattttttaatcgtcggcccacagatgacgctccgtagggaggtgagttgatcctttccttttcatgaagagtgtacctcccttgactgacaagatgaatacacccatacgagagtagtccttacacaacctgatttggagtgtcaatctcccacaagcggacggccacggccgtgagtgtcaacacaccaatggcagcccagtcacgtccctgaagtccaggtggcggctgtgtcttctcgcgacccgtcgagatccacgaccacagatcgtcgtgcacctcctcgcactcggccacagaagcgacctggtttgtgctcttgcatccctcttgcgagtcgtgatcatgatcgtgctcttgatcttgaacagagtcttcgtcatcgtccagttcatggccaacgaggtctgcaagtgagttcagggacgcctcagaggccaaggacgacgatcgcgaaggtagcggcgttgccaagttgccgtttctgtaatcaggaaagttatatccgcccaagtcagcaaataaaccttcgttctcagtgcacagatcgcgcttctcagaactatgggtggtcgttgcaggcgagaatgggggagagacgtcgacatcaggcgctgccttgggcttggccttgttcttggacgagttgtgatgcttctttgtcatccttttttcactcggaacttgtgaggagtggggtttcgttcaaaaaaggtgcgaagggtgttgaggcggaaagagacaaaggcagtggaacagcagaaatgacaaaaagagtgcgagaaagaaagaaaaaaacagcgaggcgctcatttccctctgctttctatccatctcgatgatttttttccaaccccttttcacctttcgaggcacggtaagcaggctaattctccctttctttgtcttcatgctttcatgtttttttcatgctttcatgctttcatgcctgcacccctgcagatagatatgtcattatgcctgcgagtctgcagatgtttctgttctcggagcgcagaggcttcctctagatacaaccaaagcaacgaaggaagaaaccagcagcataaacagtctggttacgagctctgacaaaacacgcgaaagatagtcgacgtgaaggaggagttttttttggtggaaacatttctgctcgtttatttgcatcgcttccgcactcaacagtcagatccgccagaccatttaaacgagggctattgacgaaagcaacaaagtaaaaacaaaaaggcaagttagcaagagtcttacataggaactgaaccttaaagatacaacaaaagtgcgtctttcccaatacagaaaaaaaaacgggtactgtcgtaggggatggggttgagggtggtggggatgttgtgcttgatggagacgaagcgggcctcacggggcttgacgggctgtctcttcaagttgaccttgacaccatcggtcttggcctgcaacttggcggcggcgttctccttgacgcgacgcaagaagtcatcacggcacttggagtgcttgatgtgctcaatgcggatgttgacgcgcttctcgaggaaacggttgccaaccttcttgttgatgatgataccaacagcggacttggtcacgttgtagatgataccggtgcgactatgagatgggtgtggagaggaaaaagacgagttaagaacgacgagccgataaaaggcgggcacacacggataaatgtcagcgatcagtccagtggtgcgtccagaaggtgtgcaatatgggtgtcgacaatgtttccgagcaccaacaatgggtgaaggtagtcaaagtccatagcgatgcgtccatgaaagaggagacactgcgcacactgagttcaagtcaagattgacagtgtgcagtgcgcccttgatctgtgacgttaaactgctgtgatatgtccgccgtccagtagagctgaattgagctgaatcccaaatgtcgaatccagcattgtaggatcaaagtgacgatcagactcttttcgatcacaggttcgaatcaattgatgtgatgcgatgttctgatcccggatcgccattctcacacgccaggatccaattgccgatcccaagccgaaatcaaacggatttgaagcctcctgatcctgccagagatgtttctgtgttgatcctgatctctccagacgcaagacttgtgtgtgttgccgagaaagagccggcggtgaggacaacatacccgtggtagaacttgtggggcatacccttgtggatagcaccgttagccttgatgtcaacaatgtcgccgaccttgtaggtcttcaggtaggtggtaagcttgatgggcaaaccatgctccctgaagttacgggcgaacatgtggcgggtgcgagcacggataccataggagtgaggcatgatgaatcaaatctgtttgtgttgccaggatggaagagaaggaaaatcgggcataagttcgccatgttctttcgagggtccttgaatctgtcctgtaaatttttttttttcctctgaatgcaatgatttgcagttgctggatcctgatcgccctccccttccattctccactgatgcgcttcttctgttcttctcctcccgtccgttgatggcggttcccatggccgtgcggctggaatgcgatttcaaccagtccgtaccctaagaggtcaagaaagaaaggagggaatcaaaacaaactggcggagcgggcgctatgaacgcaactgcgaaaaaattatcccgtgcgctgattggccacatcgctgtacctagagtcaattcagtggccactctacaggccagcgtacgtgttgcctggctgctgcagcctgattcgccagacaccccggccctgaccgggggtcacttcctgttatagcagtcgtttgtttattgttgctatttcttaaattttttctgtctctccccacccagggccataagagatcgcactgtgctgcatccagacaagatccttctctttctctaatcagtcctagccagtaagttggattccctggaggctcggtcctctctgtctgtgtgtctgtctgtctgtccatgtcaactcgactggtacaggtcttggctcgcacggccgagttgcagagacacaccaccactagtggtttattgaatcgttttactgtggggcatcgttcaagactgtgtgatgtggagtgtgaggcatcccttgcatgggaccttgtgaagctcacacatcttgtcgtagtccacatgagccacaaagacaaaaccttgttatactgcacgatggacagcaaagaggtcatccactaacgcctctttgcctgctcgtgtgtagtgccttccggagctcccaagaactgctcaaagacctacaaggtcccccgtcgtcccttcgaggccgcccgtctcgaccaggagctcaagctcgttggagagtacggtctccgcaacaagcgcgagatctggcgcattggtttcaccctgtccaacatccgtcgtgctgcccgtgagctcttgaccctcgaggacaaggacccccgtcgcctgttcgagggtaacgcattgattcgccgtcttgtgcgcatcggtgtcttggacgaggacaagatgaagctcgattacgtcttggccttgaagattgaggacttcttggagcgtcgcctccagacccaggtcttcaagctcggtcttgccaagtccatccaccacgcccgtgtcttgatccgtcagcgccacatccgcgtcggcaagcaggtcgttgacattccttccttcgttgtccgtctcgactcccagaagcacattgacttctcgctcacctccccctacggtggtggacgtgctggtcgtgtcaagagaaagcgcgctgccgctgctgcctccaagggcgatgatgccgaggaggatgacgaataaaccatccgttccaacgtctagtacgatcacggttcagattttattttcacagcatcttgactatttcatgtctgtgtttcgttctggttctttgtttgctccgtgccttgatacttagatcgacgtcggtatgagttgcattgcggtgctgtgtgtggtatagtgttgttgaagatagacagaaaccatggctagtcggtggtttagtagtgccgctatctcgtgcatatgcttggagaatcgatgcatttgaactgtgtgttctttttttttttttttttttttttttttttttggccgtggcgacatgctcgcttaaagcatccctgctgtagacctaccaaaactaagagcgcgtggcagggccaattgcaatcttcaaggttatggttttgagcgagaggtgaagcagaaaaaaaaaaaaaaaaaaagccaccgttaaacaacaagcaaaaaatggccctttgtgccagtgcaaagtacagcaatacgacccaatactccacaacacactttgcatcaccaccccatcaccccttcccttttttcatcacactccagcatggcagccgagaagcagaccaagaagcagaaaaagtcgagcgagttcagaacgaagaagagaaagctcgacgacagcattcccgatgtgcccgaggaggacactggcgaccacgacgacaacaaggacgagagcagcgctaagcgcaccaaagtcaccaaagtcaccaaggaggccaaggacaccaaagaaaccaaggaaactaaggaaaataaggacatcaaagacgccagtgaagatggaaagaagaagcgcagaagaggcaagggcgctgccaaggacgaggccaaggacgccacagagactaaggaaggcactactgaggaatcaaaagaggtcaaggctgtacccaagaatcaaaagttcattgtctttgttggtatgtcaacttttgcgctttcctccttcttgatcacctctggcaggaccataccggcagatccgaataatgactttcgaatcttgactgatttttttcattttttcattttctttgatcaggtaaccttccattcaacatcactaaggaggtcctggagaagcactttgagagctgcggtaagaacgttgacttgcgcccatcagtatatcagaacaggaccatgtcgcattgtcaagactagatgtactgagacatgttttcgttttctccaaccatgaaccacggcgatcccttaggcaagatcacatcagtgagagtgcaaacggacaaagtgaccggaaagggcaagggattcgcattcatggagttcccagaggctgaagccatgcaggtatggagacgaaaagcggattccatgctgggctttaaatcccacaagttgaaagtgttgtacaacattggcagtcaacctaatgcggatttgacgtcttgtgcactttttagaaagcattatacttcaacaagacactgatcaaggaacgacccatcaacgtggaactgacagccggtggtggaggaaacaagagcgcagccaggaaaaagaagattgcagacaagaacgaagccttgaacgaagaacgcgtatgtgcacacctgctggtcatcaaaacggatcctatcctaggtccctactgagattagagatcgctggctaatctcgtgttttcttttctttttcggcttttagcgcaaggttcatgagaagcatatcgcaccggccaaggaggccaagtcgtcgtatgcagcagccaacccccctgtggttcagaagaaggccgtcaaggccatcaagaagccatccgagatcagtggagccaacgcagtgtcggtggatggactttcgtcgcgtctccgcagggcatagaaaaaaaagcgtgcctcgactttattattttttcttcttcatatcgctcccttgttgcatcttctacgtttttttcattaaaaaataccacgcatttttctgaagcgcgcggctgcgcgtggatatggcctctttcacatgcatgtgcatgggatgaggttatctatgccttgtcccccgactcccccctgttttttctaccagcgcatctcaaatgccgcaattttggttcaattgcctcatgtttttagaaagacaacaggtgagagttgaaggatctgggaaaaagccaaagagatggctgaacacaaataagagcatcaacaacacacacacacaaaaaaagaaaagacgagcggttgtttactctgcgcgcacgtgtgtctgtggctctgctcgaaccatggcccatggcctcctggtgcgggaatgcaagtgaaaatggctgggcccacccgatctggacaatttgtgtgaccagatggggtgtgcggcgggaaaaaagggttgttctttttttttttttttaacagttatattctgagcacagcgtcgttttcatgtgtcagagctgaagggtcgagcgatagggatccggtggcatgggtggcatgcagacatgacgagcaaaggcgaccgttggagacaaggcaagtttgtatggtgtagttggttatcacgtctgtctaacacacagacggtcctcggttcaagtccgagtacaaacacttttgcatttttggtgcggctccatcacactcgcgcgtttttttcgcgttttttgttggaaaaagataatctggcatgcatttcagtttatcttgaccctcatccgagagccagtgattcgcctggcaaaaagacgtttggatatggaggaggatttgccagagaatcgtctttttctgagcaactcctgtccttcatattcaccacccgcacaactcatatcgtggacgcactttggagaagaggcttgatttcgacggacgcgctaaccacctttttttttatttttttattgctaatgtacaatccgaaggaaacgcgatggtggccgagggatcatagtgcctcgggcacggtcccgaagtgaaggattctgtacatggtctcatcgtcaacatccggtccaaccgtgaggaaacctgactgtgttgaaatctcagtcctcaagactctgggcgcctctgtagggtacatgttgaaggcatccagcaggcttgtcgaatggggtatggtggtggttatggcggtccggggcgaggaaaatgcgggcaacggcaggagatcactcaccgttggctggtagccgacctggttccgagacggatacgaggggtgaggcaaagggagttggacaagcggccggtattgctggagagggtccttgaactcttgctgtgtctgctggctcttcatcttttctcgttctagatcaatcgcgagctgcatcatttcggatgatttggactcttgaaagctcttgccaacactcggaaccgcactgtcgatcaaaacaccgcccagaggtccatatgcagagcctgaggtgtccgaggtgcctgatcgtgtctgggcacccacccactttgactgcccttcctctggcgacatgcggatccgggatgccatattgcacaagatgtcccatgcgatccaagcaaaggtatagggctgattggattccaagtcttggtagcagacagcataccaggccgcggctttcatctccaactgcggctgattggctggagcgacaatctttgaatccgggctgtaaaactcttgcaccagctccaggcggaacttgcgcttgattccagcaaaagcactgttgatggcctttcggacatcatgttccttcttgttcgtgagcatgtccacacctagaataaatccactcacgacctccagatcgctggtgagatggcaagggtgcaaaggatggttagagagagagttggaaaagacttgaggagaaacataatgagcaggcaagcctgataataggaaagaagcacgcgcctttacctcttgacaccatactgattcatcagcgaatggacctcgtcatcatacatgaccttggaccgtcgagcgttctccagataagtctcatagccctcaactagcagaagctcattgaaggactggcggtagtccttgggcttgaaagactcgtgctttccacactccctataaatctgtccaagaacacgcctcgagatgtaggtcttgtcgggcgatttttccatgaaatccggatacttcttgggtcgcagttctggtttaatagttgccggtttcccacttttcgggaaatcgacagcatcagaatgtagctgtgccagccgcaagcactttccgtgaaacggtccttcctcgagctggtccgaaagtgccaaatgggcgtgagcaatcagtccgagattgttggagacggcgtattgaacaaagaacttttgaatgtcccaaatcgtaacatcgttgcttgttagggtctcacggccaacgtactccatgggcttgacctcgttgatgttctcgacgatatctgggtcccagatcactctgataattacgaagcgtttgaaaaaaagggcacatacaagttaaaacatgagcgatcctgatcgttgtccacctgggcgtcgaccatcgtctcgcacacttacgtaaagtctagatgattgacaaatgtaaacggcgctaaagatgagtatggggacttataggcaactataaatgagcaggatcttgacgatggcggtacgacttaccatctccatcgagatcgcctccactgcacatgctgggaatgcctcgagttcccttcgtattaaagatgacgacatcgtgcaaatgcctcagctcaggtcggttgacggcgcggacaactctgacatcaccaggatggaagcaagggcaacgcaccaccatacacttgccctcgacaaccgtgcgcttggttgggttctctgcgctcgacacttgaacgaaaatctcgccctcgtctaggacacccatctcatcacagactccaagaagataggcgcctttaggcacatagatcctggccttcttggacagctcctccagcatctgcagtttgaagagtgtcaacaagttcttgatgaatggatcctggcgcttcagaaacccgactcggatcatcgtggccatcatcttgcacgtgccgctctcgtcccagttctgcagcagcatcttgatggcgatactatcatctgactccatcctctctaaatctctcatcatggagtttttgaggtctaaaatcacctgggaatatgcatggaataatatcttgttaacgaaaaaggacggctcccacatagactccagtgcccagtcctatggccacgcagccgaaaaatagacgtgtaccttgttgggaacccccagtgccgtgatgaggatgatgatttgacggttcaaatagctggggatgaacgccgaggtcttgatgacctctaggacgtaatgctcaacaccaaacttcttcatacttggcctgatctgaacgcacttgtccttcagccgtggatccagcgccaacacacccttggaaccaccgattcgaatctgaaacgctgccggggtcgtctccttctccagctcgataccaatcatctgcgccagctttgaggacagccgcccgcagccatccgaaaagttgtggtcgttgcgtataatgtcgtcaatcatcttcacctcgggcgcagagagattggcgatggcccgagtcgatgaaaagcactggcccatccttgcaccgtacttggcaatcgatttgatatgtgagaaatcacccatccaatggcggatgctgtcggccgtgtggtcccctccttgcggacaaaaaaaccaagctgcgttgtcgcgcaactgactcgccgagaacgccagaaaatcgtaagtcctgttaccgatcttgatcccgttcgtcagcgtggtgaagatccggttgtagatggcgttgttggtgctagacgacccgtccttggtccagagtttgttgtgtccctcgtccgagaactcgacgcgcagaaagtagtcgctgagctgccaaaaatgcctgatgatcctgttcgaggtctcgaccgttggcggctgaaggtagagagtcgttggggtcacaatcacttttcggaggtatacacattgagggggcacgattcgaggacggatcatcatcttggatagcttcgcgatctcacgtgccaggtattcatggaggttccagatgcgtgtccgcaacgcaatgatatgctccaaaatggttgatgccatcagaggctccaagcttgccaacatctgcccaacctgctccgtaaggtcatagccgacaatgtagttgaatgacaaggctgattcgagcaggtatctgacctcgaacgacaggctgtggaaggcctcagaacgagcacatgagagctcagtatggtccatgactgtgatgatgggcgaggcgggcgcgagcaggttgaaggtcttgcactttttcataaactgatctaggctggcgaagctctttcgcccgactgtgaacctgatcactgtccattttcccaacttggaggcgagattgcttgggtccggctcagtcggcggcttgtcctgctgtgataccgagcccccagatttgcttttgaactcggtgccttccttggggatgtccaccacgcgtctcaaacacgagccaatcgaccatttggtggcatcgctggtctcgagcttagggtcgtaccgccagtacatgggcggaaaccgaaggtgaatggtcacagcggccgagtcctccagtctatcgacctgcagacacccttgctccatgtcctggaacttcgtctcaacctggtactcgatcgtctcgtccagaaatctgcgcttgaacatcagcttgatcatgcgtcggtgctcctgaaagtgagcggcaacgttggtcgtggcagtgaactctcggcagaacttgtcctgactcagcttgacgccgagctccagactgtttgccgctacgacagcgaagcgactgtcgcctcgccggtccaacaagtccatgtccactagacgcccgccaatgttggctccgaggagccctgcgatgtcgtggggtttggtctcgtacttgaggattgcatggctctttggtttatcctctgggcggtcgatcgtgatatccaccaccttcccaaaggcttggaagacggctttgagttccgaggccgtcaccttgtcatccagatcgttgatccgcagcctcatgttgtcgaactcatccctgttccggatgtcctgctcaaactttttgcgacgcgcgagcggcgaggctctctggtggggcgtaggaggcagctgcggtactgggggcggctgagaacgtatccacaggtcgtcactctgtgcgtttggataggacggggaggacgacgtggaggacgaagacgaggacatggaggaggacatggaggacgcagaggatgagaagggtgcgacggaccggtcgcccggccgagacagccgaaggcgtcgggacatggggaagagggcgaggaatgcacctctctagtgtggattgtaggcgtgatggtcggagtgaggatggagtgttgcttggcgaagcacagggaatgagaatgaggcaggcggtgcgccaacgcaagggcagaagggcagaagggcagtggaggagacgaagcggcaaaggacgagagcaaagggacgagagcgagggtgtgagagacgagaaagagaaagagggagagagagcgacgaaaagagagagtgagagagcacaaaacgcgcgaaacaacagcatgccagtgcgaacaaacacccctatggctgggtgatgcaaccattggctggcctcaacgccaccactccgccaaaaaaaagggactgcgtcttttgtctttgttcgtgccttgttgctgccccagtctttgcgtcaaatcccacccttcattcacgaccatccacctggccaggacgcgtccacacagcctcttgcgtatccatttcagccagcacagccagtcatccctccatccctccatccctccatccctccatccacagcagccgccccatgggagcaacctgtctcgtccactggcgggacgccaacggccagcaatccctcaccctcctctccgacaggctcctcaaacagttccatgccacccccatcggccgctggaccatcaactggaaggtcttcagagacaccagcctcgtctcaaagtctggcacgggcaaaatgatgcacgtggtccacgtccagggcggcgccaccgcacgcggcgtccctgcaggctcacaggccgccaacctcaacgcaggaggaccgtccactggatcaggactcacagccagtgctggcattggagcgggtggcgctggactcatgtcctcaggcatgatgcctgcaggttcgaacggtatggccatgtccagcgcttccggaggtctcccctcaggcgttgtgggaggcggtatcggtggacccggaaagccaggacttggcatactatcatctggagcaggaggcggtggtggtgttggaggtggaggtggaggaggcggaccttcctctggagctggcgccgtaggtccaggtgcgacgggcggctcaggagtaggacaggctggcgcagacaacgcaatagcatggtgcttgatcgacgatggagcagtcggcgtcgcctcgacctcctctgctgcaccgagcgtcgtgagcacaccggcgagttcggcaggaatagagaacacagttgcccagccatcaccacccaagcgaaaggctgttcttgttgaggtagaaaaggatatcgaggcactgatagcaaagctcaaaaacttgtgggttcatcgacagcatgctcaggtggaggtgagtgtcccttttgactcgcaagaagccgtgattctcgtgtttctgtcttgatcctcctcttctcgccatcgtgtttagttttgcattctactcactgtcttgatcctccatcactttctctactcagggccacatattcgatctcggagactttatcgtcagggcaggaaatatcatggtcgcgtctactagctacaaaggaatgctgatcgaggtaaggatttgaacttcaaaatagcatctgcatgtgttcctggcagactttagcaagaggataaaaagaccgacatctcagcatcgttcgcgtttcctgcacgtctccatcgtttttccatagatcgaatatcttccacagacatcaagcgccatagcatcaaatgccatcctcgaggaatttgtccgcctcatctcaccacctggcgtcaacttgtgctcacctcagatgctcgattatccgtacgaacaggtcggtctggatcccaaaaagtggtccatgctgcactctggtttccaatacatgactctcttcaggcggcagcatatcctatagccgtgcaataaacctccctttcgcaaaaattgaatctctttttattttctcgacgttttgttcttggatgtgtagtttacagcactagaggggaaaatgagagtaggaccaatgttagaacagaaacatgcgtactatcctaccgcgccaatccactgtcgatatctccttctcaaccacttactctcatcatctccttgaggaggcttgggtgcgcctccagcaccgggcataccgcccatgttgcccatcaatccgcgggcactaatcatgaaaaagtagaagccagtcaggtcgtttgcacacttcaacaatcatactaaatttcctcccttcctttcatacgaaaaaaaacagaacttacgcctcggcaatctcaggatccctcatcatctcatcaatgttagggcgttcaccgccagccatcatgcgctgagccatctgctgcatagcagggttgctcatcaacgagttcagggctccagactgcatcatttgctgcgccatgttcatcaaagcagggttgctcatcagacctgccaagtcgggcataccaccggcaccaccgccaagagcgctcaagtcggggaaacctggaggaaggccacctgctcctgctcctgcgccagcgccagctcctgctcctccgcgggcagaaggggccacttcgttgtcgcgggccttggtgcgtgcagtagcgagggagctcttcatcgtagcgttgttgggctcaagggtcaagcccttctcgtaggccgaaacagcttccttgtatttgccgacagagaagtatgcgtgaccaagacggctgtaagccttgctgtaggatgggtcgacttcagcagccttgagcgagtccgtgatggcgttttggtggtcacccatttggctgtatgcggcagcactacaggatcgcaaagaaaagtcgtgtgaagaatgcactgggtcagaaggcgcctgagaaaaagtgtatcatcatgttggtgtgatcgcgtccaagtttctcaccggttagcgtagtaaacggcgttcttggggttaagaacaatggcctcgccgtagagacggatagcctcagcatagtccttctcattcaccttgcggttgcctatatagagagagagagaaaaaaaaaaaagacggcacgtcagcacacctgttcccttaagtgtcaacccggcaaagctgaatcggccaagaaataatgtcactccgtgccgacaaccagtcgcgacgcatacctgcaaccttaagctcctcagcattcttcttttcctcgtcagtgggctccgaagaaaggggggccgatttggcagaaggtgctggagcagaagaagcagatgcagcagcagcgttctaacaagacaatcatatcaaaacaaaaggtatcgatagttagtgtcaaagccaaaagaacttgtgagaaacatgcccacgaaggtaatgcaaacacgcgagccgttgtttctggtcgttgaaagagttgacttgacaaaagtcttccagctaagttgtacaatatcatggtccctgaggttggaacagcgccgggttccagttcatcagtatacatcgtgatcagcctctcgatcctcctgagaccttgagagtatcacagcctgtcgtcctgaccacccaagggctctttttgggcttgcttttccatgtcctgatagtacgatgaaaatctgtactgctatagttgtgtaccttgtttccgagcttcttctgggcattgacaaacacatcaaagatggagaccaaagtggcgggcttcgtgctataggtctgagcttgaacggcatcgttcaagtcgactccaaaggcctctccaatgcactgaatggcgactagatgtagagattcgtcgaaggaaacgaacgggagcaaatttagcatcggaattcctcggctgtcgccaaggcgatcgaccgggaagcctttgcgagtctagcatgctctagcctcaggctactccggtaccttcaacaccttccgagtcatccggcttgatggtgccattgttgagcgaggcctggaggaactcgaggatggagaacacgaggtgcttctgcttgtcgtctgccatagtgctgatgcgtgtgtagagctgaagagtagtgtggttgatggaacaaaaaaaaaaaggaaccttgtggaagttacgaccacacacagagaaagataacgtgacctttactggaaaaaaaaagacgaaaaaaaaattgaaaaaaaagacggctatgagagagttctggtcagggtcgccagagtctgttccagggggtatcttggccccaaggtgaggcgaagctcaagggtatccgtctgcatgcaaaccagacgtttaaaaagtacagagcagggtgtcaggtcctttcgcgtgtagcccgtcaagatggccagatcttcgttccagtcttgtccatatgcacacattgcgatccacatggcctgaaggacaccaatgatgatgaaatatcagtccatgcgcactcaagtagttaaccagtgctttacattcattcagtactcaccgaagctgctatttgagacgtgttgaagtcgagaaactcgtgcgagatcagactgaaatcgcacaggaactattgatatgatgaaacagttcaagttcgtcagaacaagacaacccatgcggccctgagtctcatatcctttgaagaggtggggttcagttcacatacatcgataagcagcatcacatccgggtggtcaggaatggccctcttgaagtagtctgagaagcctgtagcactggccactagaacttcaaacttgagggtcactagcatcgtaagttccgtactggcaatctccttggttgagtaaagatcgcagagaccgcacaggtcctgtgtactgagtctgatggtgttttcctccagttttctgtgagaaagaaagaaaagtcgtcaataattttccagacatggctcgatgggcacaggacagcggcaggaagctgtagctcacatacccagcaatcatgagcgcgcacatcccaacgcactgtagcttgtccaaaggcaccttctcaagagtccgtgccgtgatatatcgatccagcaagttcactaggaccgggcgagaagaacggtgcagatgttaggcaagatcagtcaatgatagcgcatgtaggcagatgggcgggagaatacattttcttaccggcagcatgaagagtcacgggctgaaagcgaaagtaaccgtagcacagctccatcaaccactgaaccaggactgagcggttgaacgcaaagtcagacggaggcgtcatatacatatatcggtcgtatcgtccttcaatctcatggaggtaattgagggtatcctgtgcgtattcctcccagtacgtgtgattcatggggaacgggttcacgatatgtagccgtgggcgtgccaaagctataggtcgcaacagaaaaaacaaaaaaagtagctgatccgattagcacgtacacgtacatgagtgaacgcagcggcgtgcgttacacagaacatttaaagttgcacgcgacgagatatagctcttctgctgctcttaccctttctcggctgtcgtgtcatcaacggtcccagcggttcccgcatcgccacgggttctaatggctgtgtatgtatcgaaacatgtataggcagtggttcaagtgtcaaattcgaaggctaggagtcgtaatgcatgtcaaacaacagtgaatgaagtcagtacaaacattagaaacctgattatccaatccatagggccatagcacgtatcacaatgcaccagcacgccctagtcaggggtgccatctctaaaaaatttcaacaactgaaaattcgcttgtgattgttgaagatgagagtaggatggcagtgtcaagtcaagaagacgcgtcaacaaagcgcggaggggagacaggaaagggggcagctgggaaagcgcaaaaaaaggggcagataatctaccatgcactggcgatccgtccgcacaccttggacgttcaagagtgtcgttacagaacccgctggtgcgatggaaggcaagggggaagaggtacttactacggccgctgtagctatcctgctaggggtcatgatctctgacaagggcgtccttctcgctctaggtttccttggtgtctgtggcacaagcatgttttctgaatccaaagcgttttccgagtccagagcgttttctgtatccgtctccatcacaatatcgtcgctctcgatcaaaacatcccccgttgagccttcaggatggctcggcagggttgagctacccgttggcgacccgtctccgagcttcatatccacaaagccagtgatgtttgtcgagtttttgcgcaacatggggggtcgttcgccttcactcatggtcacggttcgcaactgtcgacctgctgcgcctcgaaggtcgactctcgatctcttgttgctatcagaggctggaggatcgtcagggcatggcgaccagaagtcgtcactttggctgaagcgctcctcctgcgacgaattctcaccctgctgagatgcttcctctgcgtctgtcgcttcgccaatggtattgcgggtatggaggggcgcacgatgccgccccggtacgaaaggtggctttgctgcagacattgaacgggggcgttgacacttagccatcgtctgagagcggggtcgcgggcgagcagagggtgactctgctgccctacgtttgggaatctcttcccgagtggacaaagagattgtggactcggacatagattgctgacgatatcgctcgtcgtcgaaaatctctggtatggcgcggtaggaaggtggtggggtgtaacagccgcgcgaggtggcggttagccctgtgctgatgccaaatgccaggatagcactgttctttcctcggagcatcgaaggcaggtattgctgctgaggtgtggccactagtgaaccaacagtcgacgtggacccattggtgacagtgtctgaggatgtgggcgaaggcgatgtgatgctttctggaggagagcgcatctgcagagcacccatgggaggctcgttggggactttggtaaccatgccggtgcctagcagggcggaggtagacagagaagagggcgacgagatgtgggcgatgttgaaggtggaggcatcaatggtcgagtccatgatggggtagggaagggacctacagccgtcagctgggttgtcgagggccaatcgagtggatagatacgtaaggcaaggcgtctgtgtaagtgtccagcgtgagtgtttgtccttctcctcgctcgcaacaaaaggggaggcaaaggcgacagtgcaggacaacgtgaaagtccaaatcgttatcaaggaaggggcctagagtgggattagggttgagggacgtcaggaagacggctgctgctgcctgtgcctctgctactgcttctggctgcactgggaggaagaggaggaggaggagtagggagaagagagagaagagaagagagggagaaaaagaaggaaacgacgagaatcaagggtaaaaaaggactcgagtagggcgagagagacagcgagcgagagccaacagcagcagcgagatagatagacggacagagagagagactggcggcgaggggtctgtctactctgcagtacgagggggacgataatcggttggttggcgggtctggtttcgtttgggttgggagtgtggtgggtgtttttttgatcgggtacaattgagcccttccttgaacgaggttctattcgcaggcgaggaatcaacagacacggtggcaaacagggagacaagggctagtgcgtatcgtgggagtggcaaatgtccaagccgagcaggtcagtcgaggaagagctgtcggattcaaacggatgccgcggaggcagcagaggacaatgacaagacaaacacacaacagaagtgtcgagcagatgtttgttttggggaggcggggtcaaagtataagaagagcaagaagaatacaaaggggaagaacaagaacaaggacaagaaacacaggtaaaaaaaaagaggtacctgaatgactgggaggtgtggatgaacaacataaaactgtggatgaaccgacgaagaaaatagcacgaggcgggggtagagatcggtctctgcgtctacgggcaaatgcagtcgcagtggtgggtggaggtgggtccgagggtgaaagagagacgaggggggctgatgctgatggccgtcagagtgcttgaatgtgcgactctgaaagagttttcctctttggccaagggggttcaggagtgtccactgagggaaaaataaaaaggaaaagaagaaaagaaaaaaaaaacaacctggagagccaaagtcggcgttgtccttgacgtcttgaaccggcaacataaaaaagtcacttttccttgtctcagcgatcagcagtgcatcagagttcaagaccaccgccgcgttaccagtgtagagctgcagaaaagtcgtctgcatccccagatgcaagtgtttgactggtcggatcagaagtcctgtgtgcgagacgacgcagacagctgccatgggccagagacgcagagtcgtcgaatgcgacgatccctttcggagctactaaagtgaacgatcgtcattgaacaggggctacaccatgcctgtaggccttcagctcctgccagtcatctgttagaggtgtagaccaagcgaagcagatccacactctcgtcggcatcctagtttattaatatgagtgtctgcagtgctgcaccctcctctgtgatctcatcgcaaagctcgtccgtgggggataaggatctgcgctcaggcccactcgctcgcgacgacgggcgtcacatgcagcgacaaaagatttccacgcgagttttacgccaccaacaactccttcagccaacctctgcaatctcctatctctcatagaagccattgtccgcttcccataggggcaagatgcgtagcgcgaagacactaccgacgagacacagtggcaaatggttactgatttgggctgttcctcggcgataaactgcagccaagggactcagcggctgctagtcattctgcacattcctctcaaaccgtcctctgctacagccttcttttcccgtcctttttcttccacttcataaacaaacttttcattcttcattctctacctactcttgcttgccatcgttctgaacgacgatccctcttcatccatcctgcatcttgcttcgtttgtcttgcgttcactcctcgttgcctgctcctcacacacgacgtcacagaaaacagtgcatacatcccagcctcgacttgccatacgtatctttgtcacctcgatgagtgcagcaaccgcgaccaccagtgggtacatgtccatggacacttcaccaccgcacccaagcaccctcagcggtcaaaagccccagcatgccgtcatcactatagtcgccatagtctgctgcatcggtctccttggcttcagcatcggctaccttcgactacgacagatgagacgcatcaaaaggccctcgcccaccgcaccaccatcatcatcatcatcagcagcagcaacagtcgcccacagacatcatggtttctcggccagtcgatcaggagcctattcttcataccagccaagcaagccagatccactgtcgtgtcacctcactcttccgctgtacatgccacccatgccacccaagacagaatcatccgaagcagtaccacaacatccatcgcctcctcttcctctagagtcccctccctcctacgagacgctgaatcggcaaaggccgttgcagtcacatgaagtacaataactaaaatgcagtcgcccatatagcattctactcgggacagagtctgactttcaagtgcacgcagttttgtcatcaaacagacgccaacagagtgagccacactgcatgctgctcttgacgcttcaacaaatggtgcctgaactgatttttaacgccatgataaagaaaaaaaatatgcaaaagccctgggacgggacatgggaaacgccgagggcaaaagaaaaaaaaacgctacataccgtcaacttatccacctctgggctgtcggcaaaccacattcttccgtgagcatcatagaacatcatcaagtcaagagggcacaacagaaatggagaaaaaaaggatgaagattggatatggtggtacatccatgatgcatgggtctatcgtataatctgtttcttgcatgggggtgttcgaatcgcgcatcaagtctagtgttcatccggcaactgtattccgtgcataaaacaaaacaaaacaaggttagtgattgtaagaccatggccgggaaccgagagaaggaatggcagagagagagaaaagtgcgaacagttttaaaaaactcaccagtgccaacaatctcatcggcttttcgcagagcctcaatcatctttttacactccttgcggcgattctgggtgaactcgctctccttcatcagctcatccaacacctcagtcttgtacagctcgtggagcagctcgcgctgcagttcctccttggcagtgttaacgaggttgagcatgatggccttgggaacggtgtcgatcacggtgcgcttcacaatgttgaagtaggaggagataagcagcttaatgacttcggtttcagtctgctcgcgctccgacaagtttcctgaggccttcaaaaccgctggtggagcctccatcacgctggcgcgcttcttcttgccagagaaaaagcttccaaagaagccgttgttgttcggctcgggctcaaggcttggaggcaggttggtcaatgccgcattgcgattcttgggatcaaccggctgggggttcttggcttgattcgcgcggtcatggataacggccatagccttgtggccgttcaggaaatcgggatgaccagtgttgaggtagcaagattccatactatggataagagtgtcaggttaagaatgatgtttaccacgcaaagaccgcatggcggctatcggcaccagatggagcgccggttacctaatcaagtcctgaacgagtttgttggttgggttcagctgtttgcggaagtagttgatgacaacctgatagaagcgatccttgagctgcgggaaccgcttgaagagctatgtatggtgaaaaaagttgaacttttgttaaaaaaccatggtcctaaccaggagcgaagagtatcatagaaaagtaagctgtagtctctctcaactgtacctgcttggacaacagctgggacaagatgcgaacaagctcatcaaaaaccatgttcacacagcgcaaactagggtcctccaggcgtttgatctgttgcttgatgattacttcgaaagctgttgcgccgacaaagagtgcaggcgatgaaccctatggcacgaatgatcgaagacggtccttgctgagttgggcagttcatacaacatctgatccatcttttggcgttcttcgaaaacacttactgaagagttgtaaagaatggtgcggatgtcgacgtccttgacctgatcaaacggatccaacgacttcacaccgttcgcataaagctcatggaacacaaagctgatacgagcaccacctgacagttcaaacgaggataggtccgtagagttgccgtcgatgatagtgcggaactctgtgcaaaactcggtgatgatgttgagcacgatgttggcttgtcctgctccttccatcatcccatccccaagagtagcaagctctgcctcatacttggctaaagccgcctggatctttgccttgatttctggcaatgtattgcggatgtgatacatcaggatctagtaatgttcagtatggaagcattagtcaaaaacaaaacccacaacttcaaagtgagctgaaacctgttgacaccttacgcgtcgccttaccatattcaatttccgtgccaagtaaggagttccgcagtactgggctttgcttctgtatgcgacgtggttatcaaagaaagcgcgttcgccctcaagtgaccggctgatcgacttcttagtgtcaatatcacgctgtccgcgattgacaacaggaacatatccaagacgaagaggaatgacacgcccagccaggatatccaccacgtccgttccggaatccctgaagagacgagtgttcatcaaactgttagaggcaaaaaaccatagtgcgcatactcacatcgcacatcgtcccttcaacaaccggctctcttacatcaaatcgattttggtcaacactccaatggttctggctccctcaggatcgacatcacgggccaaacgtagaccatccgagttggcgagatcgacattagcggctgtgacagccagaatgatagagttgggtttggtgatgtacttgacaatcatatccctgatctgcttctcaatgtccttgggctgatctcccactggaagctattgcgttttcgcgcgaatgaatggttattacagaaataagaacgtaatgggccacggcaagcatattggtttacaagtgatcctcaaattataccttggtcaatcctggcaagtcgacaagggtcagggtcaagacgtgaggagagtagattcgaaggttgatgggcaggggggagatgcctggaaacgagcgtagaggtgcggcgaagcatctgttagttaacctaggcctaatagtcaaactgcatatgcagacactgcacattgtgacgctgacactgacaactggaaaaagcctataacataccggcattcttccctgtcttggcctctgtgtcacggacaatctcctcgcggatgaggttgaagtccgtgtacttgacgccgggctggtgcagaaactcgccccactcctcgggctctttaggctctttgctgtcctcgctttcctcggcacctatgagacggccgaaatgcaggcggttagatcatatcatccctatctcttcaagtcaggcgatcccctatttttcacgatcttttcaggccaacggatggctttgtgttgacactgcgattaaaacgacgtgccatcctgtcgggtcacatggatccaggcacaacgatccgatgttctcccgttccacgcatccaacatcccatagcgatagcaatggcagcatcaatagcaaacagcaacagcagcatcaatagcaaacttgccctcttctttgttgtccttgtctccggtctctgcgacgggatttgtggaaggtctgttgatgagttggaggaccttagattgataagccgcgggacgggaacagggatgacagggaggcaaacaaggaggcatgctggttagtcaactgcctttcatgctgtgggcacgtcgaagtcttgaacaaggcggagtgctgagttaccagaggacgacgagtcacgatgccagcgccgcgaggcaaaaagtcgcgtccgacaatgttttcgagaacggagctctttccagaggattgagagccgatgacgacgatttgaggcaggtccacggggttgtgtacgccgacggttgagaaggcatcctgcagcttgttgatggtcctgatgagcgttgcatccatggctgagacctgagagtgaagttgttgctatgcgatatgtgtgctgggatggactgctgcgttgtggtacgaaggcgacggcgtaggggagacggtgtggttggatggaagggaaggatgggaaggatgggaaggagagagcgatgaagatagcgagatggggatgggatgagagagatgaagagaagaaaaaggaaaagagcgaggagtcaaagtcgactctttttttatggccctgttgaggcccttctcctttaggcttttcccccctctgctgtcccctccacgtatcacacagagatgccaagccaaacaggctagcccacaagaccctcttgctcttttgatcgcaagtgctgctctcttcccctttgacctccccgtcgtcgtgctttgcttcaccctcagccgcctttcgtcctccatcagtttttctcagcagcgacgaatgcactcgatggatcgctcgatggatctctcgatggactggttcaagcacagacggctacggccctcagttcgtcgcaagctccgtcgcatccgaactagctttcgcctacacacccgaaggaacgtgctcgtcctgctgatcagcacctttctgatcctccacatcatctcgcgcatcggacgacaccgcaactctgtcgagcagagatggcagcggttacagcaatttgttcagccaggcatcttaggtgctccttcaaatctggccttgaatggcccagacgcagttcgggttcagctgtgcaacgtggacggtcgactttgctcgtcttggaaccatgagagactttgggaacatgacgagctgaacagggatgagtcttggctaaagcccggatccatcagagtgcccatcggggtacaggctacgctgaccatgaaggacggacagcaacgcagactcagatatggtcatcacaagtgcgatccatccacgctggactgtcaaggaattcaaaggatggctgtgcaaggtatgcgatttgctatcatgtcagatgagcccgagcaaacacttccatcgcgtccgattctaacttgcgctactaccaactgggggtatatttcagagagcatcatgtcagcaatagagaaaatcgcagagtcatgctcagggagcaactggttagaggagcccgccattattcacacgatccagcccaaacgaacttcctccaagcgggacgtctcgatgatcgcgcaattctctatcagccgtttggaacggtttgagcatgccagacgcgtttggccggggcccatctctgttgtgatgtaagcacagcgcagctcattgctctccatactcgcgtcaatccacgtctattcctagtccaaaaagactgatccaaggcgatctcaaacattcctagctttctggcaacaaacgaggacatcgtcaagctcaaagagtactttgagcagccagacaaaatggcgctgtacgagactatcacattgaccatcgttaagcccgactactctcagggaacccacaaaagatacccgatcaatagcctgagaaacatcggcatccgcaccgccagcagcgactacatctacgtgatagacgcggattttgtaccgacaacacagttatacgcttttgcaaccaccaacatcatccctcttttagaaagagccaccacgccaacagcttatgtcgtgccctgccttgctatcaaagtcgagcataagggtcggtatccagatactattgaggaactgcaacccttgatgaaatcaggaatggcctacatcacggaccctcgggcagggcacggaccaacctcgacctcacttttcatgcacaagcctgtttttggacattcgccagcattcgaagtttgtttcgaatctcaatgggagccatactacattgtcaaccgcaatggcctacacccttactatgacgagcgattcaagaaccaaggcggggacaagcagagtcatgcgattttgttgaatgcgatcggatatcggttcatggtgttgcgggaccactttatgtaccatatggaccatccaaagctcaagtggacaggagatgggctagacatacacaagcaaaaggactttacgtattttgcagactatctgccagcacttgaaaacatctttggaagtaactttcggtggccatgggggtgctcacggccgctcgtgcactcgtcacggtggaatctcgagggtgccttgtaatatatagtgttattcacatctttttccttgatatcttttgtaaatgtggatgggcttcgatgcgaaatgggaaagtgatcgaccatgaacgtgccttattccattccactatcgcactattgggacgatctttgcataatcgtctggaagataattgcttcaataacgtccctccagcgaatcgtgcggcacgtattggaatatatatacacgataccaaagttcgataagacttgccatccctttcttgcacttttgcaaccatcttttcgaaccttttttttttttttttttttgtctgaagctgcttcagacaatataccctgtaaagcatgaaaagtattggctgggttctctccctacctatcttgggagccattgccgccggtataggagcacaggaggtggcaccgcccattatcgagacccagaatgcatcgcttagtgtgctgaccaacaacgtgtacatgcttactgagctcttgaactggggtcaaagtatgtacgagtgatcagcggggtttcagctgacatgacggaacacatacataaggcagaccacgctaaacctcattttcgctttgtctcgtccacaaaaaaaaaaactccctagacacgcgcgctggactcatcgctcgatcagactacgtgaaaggcatggatgttatcgttcttgaagaatgctgggccaaccgtccctgcaaaatcattcgcgacggactcagagatctgtgtaaggcttcgcccaatcgttcttttctgatttcatgatatgagcaccttctgaaacctcatctcaacctcgactccttggttccaaacagatccatatcaaacgccgaccctgggaaatgagaagaaggcttggaattcaaccactggcgcttacagctccttccgacctgtgaacggcggcgtggtcatcatgtcaaaatggccgatcaagcagcaacaccaattcatctacaaaaagtcttgtggaatcgacaggtaagacaaagtttctgaatgttcgcgtttgaacaaaaaaaagagaaaagaaaaagaaaggaaccgtaaatatgctttgtttttgttgattttattctaacgcactgtgttgttgcacgcattctccgataccgagctggacgaacaaagggtttgtctatgtcgtgttggactatctcggcaccaacatccatatctttggtactcatatgcagaatgatgacaagcggtgtgaggagggccagggcgcgcaaatacgggcaggaaatcttgacgacatgcgcgcctacattaacgcgcgcaacatcccagtcaaagaactcgtcatcattgctggcgatttcaacatcaacgacgactcggtggaatacagcacgagtctacttggccgcttgaatgtccagccggccgatgagtacgtgggatatggccacagctttgatcctatggaggtaaagggaggatgacacattgatgagactcaaggtgatggacgtcacttttttttccacttcaagatgtcttaacttattccccttaccaccctgtggttcatccagaactcaattgcaggcagaaattttcctggcaagcagggcatgtcagtcgactttgtgtttgtggacaaggcccataaccagagcgtcaggtccattgtccagaccctgctcaaggtccactctgcagactataggcttaagggacgcgtctttgatgacttctcggaccactttcccgtcaaagctgtgattgagctggatctcgcagcagagagagaacccctgtcagccaatatcactttggtctcaggcaatgtcacctcggtctcagccaatatcacctgggtcgcgtagtattattcatagcaatcataggttcccatacaataagcgttgtgttctgtttcgttcctactctttatcagaatcaaagcctggagaagccctatagctcaccataaaataaaggtggcaggtatatctagagtacagccaggatgataacacaggtaacaatggccgcgataaggaggatgtagcaagatttgctctgtgcgctcttttgatgctcagcggcctgtgccagctcctctgttgctgcgtgggtgctcatgctgacggacgtgacgttggtctcgatcgaatcgagcataccaccttgttcagtgaccatgtttccgagatctcggaagatctcgttcaactctgtaatgccctgttcgatttcccggatctcctgttcccgctgcgtaatcatcgattcgttatactcgagttcattgtcgaccacgagcaactgaagacgcctctggctctcgttgatcaaaggctgttctcccgaatcgctatcatcgccatcgctttagtattaagtcaagaggggggtaggggggttcgttagcaggacgtaatttggctccaaagaaaaagacagattgcgaacgttcaaaaggaacaaaaaaaggtaaacatcacgtacgagtagttctgtctcgcgctaacttgacgcgccctgatgacaaactcgcgctgcttctcagcagagactctttgaaccttttgaaagtcgaccagaaccttttgaaagtccttcgagaccttttgatgctccagctttttctatatgcgatgtgtaataagcggtgagttcatttgtttgttttgagccatgggtgatgatagaaatccacaaggagcggtcggtgtgctttgatttcattgttttatgcttactccagatgcatcaaatttggtcagttccttgacctcttggctggtttcgcggactagaactctagtttgctcagtgacatcttgcctatgaagtagcggtcagtcaaaaacatttcaataatgtgttagcgcgaaggcattagtgagaagagggagaaaaaaaaaggagaggtgacctaagcatgcacgcaacaacggcatgcgcatgccgagctctgtgcctgaaattgatgtccgcatgaaaatgagtgccgccgcagcgagaggagggtgcgagaagcgaggatggaaggcaagcttaggttgttggaggcagctatgatcacgtacagttttgcccggacatcctctgagtccttggctgagccgagatatcccacgaggcgctgtattgacgagacattggaggagatgcggaagatctgctgggagatctgctgaatctttgacttgtaggcatactggctgactatgtgttggcaaaagagggaaggagggtcgaagacagggtagtgagtaaatagcaggatagacagaatggagtccggaagagcaaacacatgagcgagaaagaaggaggaagaagaagctcggatcgagagtgaggtggtcgatcgttttaaagcagaacataccgtcgcctaaactgtctgctccaccgcggttccagttgctggttgggttgctgttggtgaaggcattcctatgaacgttgccctgagtgccctggttgccaaggggactggggccagggagtcccccgcgcttgatgccaccctcgcctcgttccaaatcagcaaacgacattgtgaatgtgctcctgtttcctgcgccggttgtttcttgtaacggtgtctggttgtagccgagatcagttgatgatgtagcgcgagatggcgagagagaagaaagagcgatagagagagcgaggagagagcgtgggaacagaggatggatggagagaatcctgacgagtgagttctgggcgagaaggtctaggagaaatcgaggccgagaacgagagagcaagagagcgagagttcaggggaagacgaacaaaacctcttcagcggtgctcagctggttccagtttgtgctcttttggagttcgtcagaccgcgtgggaccgccgcacaacacaacacgtcacatagccgtaggaattgagctccatcacatgctgcatcttccagccctgccatccacaccttcgcgtcctcggctcgccccttcctcagtccctccatcctttctactttgagtacatcgcagagtgcactctgttggacttctgcagcgacatagcaccgcctcatcacagctggacagccgcgcctcaacacagtccttccttcctctgcttgcttgaccttgcgctccacgtcgcatcagccggacgactccacagtcaggatcgcacccagcaaagaatgcttggcagcaagccgaatgctaattcgaccaccactaccccatcctcaccaaacagcaagagccttggtgtcaacatgcagcagggtcctgctgcctcaggtagcgccagtgggcacgccgggaacagcaacaatggccacggcccaagcggtcgcccttacagtcgcaacggtcatctacatcaagagtctttggacccaagtgcctctagacgtcaccatgggtctaccagcgctgcctcatcgacgaccgcagccacatcgggaccgtccatggtagtgggagcgcctcggccttttcgcccaggacatgcattgcgaagggacagcaccgcttccaactacagcacactttccgaagtgtaagtcgtttggagcattcttgtggagactatagagtgcgatgtattctacgatctaacgcgccaatccatcgcgacaactggacttgaacgcgctcatagatcacagccgtggacgagggcggatattggcttcaatggtgagctactgtctggcggttgctctgaggataatgacaaaaaagcacgcagggaaactgatctctttatcgcttatggcacctgccgatactagccatctcgggagttctgaacaatcccaacaaaaggccgtcgtcagccgcaaagcccaccaaggcagatataccccctgtcacgccagtgccagtacgcaaggtcaaaggatcggagtttgacagctacatcaagcacattacgcccgtctttgaaagatatcagaataacagagcaggcgccgtgccacctgagggcgcaaacatccattctcctcgctcgcccttcgggtcgtcgttcgagtctttggcgagccattttcaaccgcagatcatgaccccattattggcacagtcaggacaggatatggacaggaccgagagcgcacgcaacccatattcagtgccagatatgccggagctgaatgaacctgttccgatgaagcctgctatgcccgacacacccgcgttgagtacagtacccgccatctttttcgatcccgactttaatttcgagaaccccaggacatttgatcttgtctgtgaacagactgcacactcaggttcgcagaacaacaacacaacttctatcgtcaccaacagcattctccaggagaagctctcgcattatctggacacggtcgagatccacctcatgacagagatttcacgccgatccacatcctttttcgaggcgctatccaaccttcaggccttgcattcgcaaacattggaatgtgtctctcagattcatgtcctccgcgctcagttggccaggattgatcacacgcagtcaaaacagggcttggaggttgtacgactcaagcggcgaagaaggaatcttggcttgttacataatggtatccggatggtcaaggagatccgatcaacgcagcccatgatacaggttctgctggggagcggcaattactttggggcactggatctaatcgacggcgcacaacgtgttctgtttgacggggacatgaagcatcttgaggctactccgggctttgatcctgatctggctctagtgccgtcctctaccgccatcgcaccgtcccctcgatctctagacgtccgtggagttttggctctcgtacatttcggcggccagctttcagagatgagaaaaatgattgggaaaatgatggagggcgaactagtgaaccttttgctgaacgactttcgactcaggatcggtaatctggacgtcgcgactctgctggtcgatttgggcaaggtcgacacttccaacaccaaattcacaaagcccagcttcattcgcggcatcaaccctcttctctcccagcaggtggagaaagagactgaacttcggaatcgaatgcgtccattgattcagggcttactcagagcgaaccgcgtaggagttgctctccagacgtacagggaacaaattctgcaagaaatcaaaaatatcatcaagtctgtaagtttaatgtcgccattagccatcggaagtgtctttgtggaagaatgtaccacttaccagaccatcctgcaccgtcgatagcaatacccacctcccgatccgagcaaagcgagtgaaaatgggcctccgtccttgaggaagaaggatcaaatgtatgtatggggtttgatttgccaagataaggaggagttgcgaatgggatgttaatgcctgcacttctcatgtctcgtcatagggccgcattaacgaatcaactgcgctccatggacgctctgacattctacaggatgctctcgtacatctatgcctttttgttgggagcatttcagcgtgtgtcactctatcatcagcttacacttttgagtatacgcgaagccgagtcccagggcacgggccagctgatcatagtggactcttcttcggaagactctgacagcatgcaggagtccgcatccttgcgcgaaatgagggaaggggagcaagataatggcgattacgaggatcaagatgatgaggaagaggagcaggacggatccgacccagagagcgtaggatttagtcttgggactgatacaccaggatcaacgcctctgcacggaattggcagaaagcgcttgagtgcaccggcaggcccgaacagtaatattttatcacccagtgccgccttctctggtaatgaccattcatcagcccttgttcgtgaattctcagcgctgcagttggatggcgaaaacagccatttgagcaccaatgccgctagccagttgttccgacagcttgagaccgagtctgaggagatcttgtttgcggtggcagatctggcccattctcgatgcgcaaaacttatgggtatgaggagtgagcaaagtgcaaagttgctggcagcagaggtctacaagctgctgaggttgacgtggtccttcgtcttgcaaagtgagctcttgtccggatacatgtgctatggtctcaggacagcgattctttctcaggtaaggccatctcgaccttctgcgtgcatgcagcctctggaaaaaatgtaaagtggtttatcctcacccaactatatttaacttgcgattttactttcgggatgtttagtccaaggcatttttgctgcagttccacatggaaaaaactagtcaactcgctctcgctgtcggcgaagaccagtgggtccaggtggaggtaccttggtcctcacaatcaactgccaatgggatcaccgctatttcagactttagtttgcaggaggctaggagtagggactttgcaatggctttcaacattctcactctctctgccccaccaccagttcaaggggtggacgatcatgacggcttcattcagtcgcgtctgggcaataaggccccgaatggatccatcaccaatggcaaagagggcgctgaggttgatgtccctgcaccgacgcgagtcttgtcgatccgtgatgaggtgttttttgtggtcggatgttctttggttctactcgatactctagccgagtacctggatatcctcaacaacattactgcccttaccaccgatgtcatgcagcgcatcattgagctcttgaaggtatgatacaaggcttgagaagaccacgcgtaaaaattatctaacaaagaccttcagtgaatctaacaacttgtttatgttctgtttttcagttgttcaactcgaggacatgccaagtgattttgggagcaggagcaatgcgttcagcaggcttgaagaatattacggccaagcatctggccttggcctcccagtcgttgagtgtctttgcgacattgataccctatgtgaaggactggatccgatcaaagatgaccgacaagcaagtggtgatgctgtcagagtttgaccgtattcttcgcgactttcaggagcatcagaacgagattcattccaagttggtgtctatcatgtcagaacgactggcactacacattcgctcgatgaccaacgcttcagtcgtagactatgatgcactcaacaagccggctcaacagctggcgaacggcggaggaagcgtgaatgcgttcatggatggacttgtgaaggatgcgatcacattgcataaagtcctgggccgcttcttgccagctgcctctatgcgggtgagtttatatggtatttgaatgcaactctggacgctgtgagagtggaagaagaggtattaatgatctttatcccgcttattgtccctccgatccttgtagagggttattgacgaggtcttgcagatctttacgatgcgtctcgaagaggagattcaaaagctacccatcaccacacctctcgggaaaacaaggtacctgtcaagtcccgttcatatgcgatagacgcggcaaagcgatgcgagttagcgccgtatgagatcgcgagctgatatattttattattttttgttatgtttgatctgtagactgcaagcggatgttgcatactatgggcaaaaactggggccgctggacccgaacggcattattggctccagactgatgaagcaagtgaaggagctcatgctcacggacaagaagaacggaggaggagcgacctcctcgacaccgcctgtttccggtggtggtgctggtcaaagtagtgctctgccggccaattaagaaccctcccatttatggaggtttaaaataaacaaggcgaggtgtgacgagctgcatagtcaggcatattagattttgcttcgcaggcgctgtttgcgtctccctctttattcattaatccacaatatgggtacagttcacgagattttttgtgctggagtgcgacgtgattgccttttatggaaccatcgtgctccactggcatggatgcgtgcaccttctcctgtgcatgtttgctaaccatcgatcgatctatctacttcatccttctatacacatcgtaccaacttgctcgccctggtcatcttcatcatctccatcggaaacttgcgtcggaaaaaaaaatatcaacatcaactgtatctgtatcatcgtggaactggatccttttttttcactgggaaatcaactgccacctcttggaaatggaaactgaataatgcacctggaaatcaatacgcccgttcgtcatcatcactggtatcaatctttgatgcgactttctcccaactggacatcacaaccctggtcggtgtgcttgctgactatgttgatccgacctcgttgattcgaccttgacagccgttggaaagaataagcgtctctcgaaaggcaagaagggtcttaagaagaaggtgtaaagtatcgttccaggaccttgttctttctattctcgggggtgcacaaaggatcaggagtcgttcacttcgggaagtgtggatagaaaaaaaaagtgaaggtccttcgttacccaccattcatttgacaaaggaggattggaagagtcggcctagcggacttgaggaatgttcaggaatatccatctaccacctcatcaaccgattgacactgtgatcctattacaacaacaggagcgactgcaactatgaccctagccatctctatggcttgaccagacgaggggaaatattttcacagcacagaaggacgtctggaggcatgaccctcttcgccgccagtcgggatatggttcagtgactcgacaatctcaacagagtactaggcaggttgccgactttgacggcttccatacctctgcgatggtcaggatggacagggccttcttcaggcaaatacgatcaccatctgatattctttaaagaacgaaaatcaagagggagagctgtggaggtttacaaacgtcgagatatctacgcaaggtattgacaaccaaatccctccatcttcaaaaatcttctagtgtcgaccccttcacccgcaaggactggtacgatatcaaggccccttcgacctttgacgttcgccaggttggcaagaccctcgtcaaccgtacccagggtatgaagaacgccaacgacgccttgaagggtcgtgtcctcgaggtctccctcgctgacttgaacaagaacgaggagtactcgttccgcaaggtcaagctgagagttgatgaggtccagggcaagaactgcctcaccaacttccacggtatggacatgacctcggacaagctccgctccatggtccgcaagtggcagtcgatcatcgaggcccacgtcgatgtcaagaccaccgatggttacttgctccgcctcttcgctgtcgccttcaccaagaagggtgtcaaccaggtcaagaagaccacctacgctcagtcggctcagatccgtcagatccgcaagaagatgttcgagatcatgactgcccaggccacctcttgcgacttgaaggagctcgtccacaagttcatccccgaggtcattggaaacgagattgagaagtcttgcaagtccatctaccccctccgtgatgtcttcatccgcaaggtcaagatcctcaaggcccccaagttcgatctcggaaagctcctcgagctccactccggtgctgacaacgagaccggtgccaaggtcgagcgcaaggacttcaaggagcccaccattctcgctgaggtttaaaataaaaacaacaccaaacgagggacctcaatcgtttcttgctgcaatttcctccttacccttacacaataaattcttttcgtgatcttgcgatatggccatttttctattctcacaaacaattatttggagggaggaaggaagggagggagggggtcacttgctgagactatcaactatgcgcctccagatgctgcctgtcttgcacgctccttctccacctctcggatcagcacggtcagctttggaacctgagactggaacttgagggccgtcatcgtggccaggacccgctctgcaggtgcccatagccgaagctcgacacaggccttcagcatgacataataaacgttccaagggatgctgcttcgattctccgacacggacaagtcgacacccccggcaacaaagtcgacacccccggcaacaacagtagtgttctgatggctggtggcgatgctcgtactcgtgttgctcgtgttgctcgagctgtcgttcccgagacgtgggagtgcctgctgcatttcactgaaccatcgctcagcatggtcgatcatggccaggttagcatatcccgaaaccaagatcgagtatgcgcccaacgaaaggccctcctgcgtccgctccttggccagcagtgccatctcctccgccaaagtcacgtcgcctgcccttagcgcgccttggatcaaggcgccgtaggtatgaactgagggctcaagtccagcctcctgcatctctttgtaaaccgcctgggctcgacccagatcgcctactttggccagccctgcaatcacagcggagtaggtgatcgccgtcttgtggatattgcggctcaacatcaactccatcaccttgttggccgactccttatcgcgctgcgaaaacaaaatgtccgtgatggtggtgtaggtggtcgcgtctggctgtgtctttgagcgttccatctgtgctaggaccttgttcagtccatcgacatcctgtaccgagagtagtccgcgaatcataatattgtaggtctccagtggtatctgaggcctcttcgacttcggcctttcctgctccatgtctatcagctgttgaaataacttgaaagcgatctctggcttgtgattgtgaaacagtccagtcagtgcggtattgtacaaggtcggtgtgggcgtgatacaatagggttcctgttgcatcgagtcccagagattcaaggccaaagtccaatccttggctcggaaacacccactcagcataatcgagaaactgtaaagatcgggttggaggttcgattccttaagcatccaattccacatggtctgcgtttcagcaaagcggcgcggttcttgacaaagagccgaaaggacagagttgtgaagcgatatcgtcactttgctttccggatgctccctgatccttgtccagacctgtatggcgtcgtcgtaccgcttggcctttagcagctcagacataacaaaggagctcgtgtattcgttggccggaaacccgaggtccatggtatggttcagcagagccattgcctcctcgtatcgttttagaccaatgagtgcgcgaagccgtcctgtaaacatcttggaattgggtgggcagctttgtgtctggatctcttgtaatattctcttggcttggatgatatggtcgctcgtgagttggagcccttttgaccatttgagaaactgggccatgaaaagtcgttccatgtccgtattccgatccatgctcgtaagcgtcccaagttcacggccgttaccggtcttgagatgcatcgccatgaggagagcaagtgtcctggggttgaacgtgactttttcgcccttcttgatcctgcgttcctcagtcataaggtcgacgatccgttgcgcctcctgatatttggtccgcttgatatggtagtgaatcaagtcgttgtaatggtcattactgactaaaacctttggccttcggtgaagttccttcatgatcatggtcagctttgtcgccagttctttgttcataacgcccttgttcgcattggagctcagccactggccaagtcgggagagctcgatgtcctcgaccaccgccttgctgtcgagctgaccctgatagagtttccaatagtcgacattgttgtcccaagctgatatgtcagggataaagctcggtcctgtataggaacggctcttgcctggagtcgaggaagtctgatttttaaggtgcgtatcatgacgggtatctttggaccgactttgctggttgagcggaccaagtgaagcggatgatgtccgggccgagagagggatctcccacgagtcctgtgctggcgcggaatggtttcgagtgttgttgcgtgtagcggttcgctttgtggttgtgttactgtgaagagacctttgactggacgaggcacgggcgacggactgggaggaccgaatggtagaggcgcgctgcgtggtctgcaggaacatccaatgcagccagtgtttagctgggtcataatgggcgcagaattctgtccctatcgtggctctagtggcgactgtcgtcgagacgcggcttcgaattcgtgcgatgctcatcgggagtcctggtttgagattactggacgctgatcaatgagctgaaaacgaaatgtgagcagccaaacttcaggtccgaactgaaagtggcttgtcctaggttgccaccatttttttttctcgaaaggcagaaaaaaaaacgtgcatgcagggtgtgcatcagttgttccttactctgcatcaaacaactttcggtcgcctggcgcctgctccattgcacagaacaccaccgctactacaaccaaggatatagactgggacatagacagggagagagaatggcgacggctgcagagaacagcaatggcccagccagcttagacgccgctctaggagacgcggctactgccaccagcgtgaattctaccaccactaccaccaccaccaccagcgacgagaccaaggaggaatccaaaaaggaggttgttttgaagcagctatacgagcagtcgacacagtactgcttctggcgctacacacaagcagccctggacgagctgcgaagcagagtgaatcaagaggtcgtttccagtatcagggccaacatcgacgaggagcgagagctggtaaagtgattgccgcctgccatatgacgaaccatgggcaacgtgatcggcaaagcagattctcacagtcggtgtatcgccacttgtcaataactttacagaggacagcgcagggtctctcggtggatcgtttaccaacggatctgcagtttctaagtgtgaacgaggagttggccctcttgggattttacgaacgcaagatcgtgcacatctttcgatactggaatttgccctcctacgtaacggtaatggagctatattttgcatctactggttaactgctgcagctgagactggatagggagctgacttgcctttatgttcttttctttggacgttaggggacggctattgtatatatgaagcgattcttcttggaaaataccatcatggactatcacccaaaggacgtcatgtaagtccaagggactgcaggagtcgggttttgctttcacttgagcggacctttttttttttgctcacgagatttctattcgaatgccgtttcgcacactttcaggttgacgtgcatgttcctcgcgcgtaagacagagaactttttgatgtcgatcgaggattttgtcaaggtcctcaagagtgacccagaaccgatcttgaatcttgagtttttggtctgcaagaacttgcgcttccactttacagtacaccacccttaccggccatgtctggggttcttttacgatatgcaggtagcaccgagttccttcgcattgttttttttccgactccctgtttatgcactttggtaggggttaacaatgatcttatttgctgatacttttcataggccacctcggatgatatggacaagctgcaaaaagtatacgaatcagctctgaaattgatcgacacctcgctgcacacggacctctgcttcttgtaccagccatctcagatcgccttggctgccatgaggatagccgccaaaaaagaatcttatgatttcgaaaagtaggtcttgtcaggacgcaatgtgcctgtgattgagaacccttttttattattttgctatcatgtctcgccctgagctcacccagatctgatttcaccatgacttctccgtaaggtatgagaactacaagttcaagaccaacgaaagtgcggctcaaaagtacaatgaggtattgtaccctgttttgctggcgatcgaacaggtcctgaaggaagatcctcgctgcacggaggtggaaaaagcagtgctgacagagatcgataaacggttgaggatgtgcaaggaccctgccaaggacccagagagtctcgtcttccgaaagaagtcgccggcagagtctatcgctgatgatgacgatgacgatgacgaacccgacaggcctgagaaacgcgccaagttgagcgatggttcacaataataaaaagattctcacacctcttttttattgttatgggtacgccaaggcaccattgctgggtatgaatgctgagtgctgagtgggcagggggggggggggggggggtgaatacaaatacaatgtccagttgggcatgaacatcctcgagggtgaactatattgagctggagagatggatctagcatatgagagccaaagtcctggcgactcctgctggagaccatcaatgactccctctcgctcgctcttcctttgactttggttctttcatttgatcaaggggatgccggtgctggtcctggccttgtagttgcgataatcctgtccaaaaaaccgcgtcaaaagttgctcctcgtactgaatccgctcggagaaaaagcggaagagaaccaccgcaaatccgatgaagcaaacggggttcatcatcatgagctgtgatcccaatgcccaatagtagaatccaaagtacgaaggatgtctcagcagactatttttttttcatgccagagtggaaggataattgagttattaataattctgagcgtgagcccctctctcataattctcacacagaccagaacaacatattaattgcctttttgtcgtttttttttcttccactgcaaaaggcgcccttacctgtagatgccatcggtcaccaagacatggtggtcctccttgtaatattcgacatgatgcgaaaagttggatttggccgagaacatggccagagttctggccaactgtcccacaatcaccaggatgagtccgatcttgttcaatagaccccaggtcttcatttgcgggaaaaaaaagtactcgatcagaaactctgtgatcccactgacggtcgctgtagtgtattcggggctgtgattcaacaagaacgctagaattgtcaacaacaagacaatagtgttagccagagttcatgccagacagatataaaaaaaaagaaagatcaacggaaaagtgccagggcttacagtccagcttgagctttgtgggattgaacagcgcgatggcgatgtactcgagtgcatggaacgctcctagggcagccaggaagagccagaactgtggaacaggagtgtgcacaatggtggccaggatcacacttgcgccaaagagcgcgcccaaaccaaaaccatacactgcaatgttctggggtgagttcttgccgtcaaagagacggaaatctgtgatagactctggtacgggtgcctgaaggtgggcgtgtgctcgttcggaggctgaggtcgaggtcgaggtcgagcccaagggcaagggtgtggttggcggggctggctgatcctgtaagctggcttctgaaggtgatctgtctacttccgtcattgctgtgggtccttggagggtgtggtggttttgtgttgactcggctgtcgctgtagacgtcgttgtgtcgatgaggaggaaggagatcaaaaagaatgagcaaagaagccagacgagagtgatctttttgttgctggcaagacggatgtgttataattcagccgcctctgattggctgtgctttacagcaactctcgcgcttccaaaatccgcttccattgctcacgcgcaggcgactcgagccgtccgtcagagtttttcaaagcgacagttctttattgctcgacgcgactctactcttctcatggcaatcgtctcatcaaaaagcggtcaaggatgcaaaaggggtacgacaaggttagaattggatatatagaggacaaaaacagagcaacgagctacgaaaacataacgccccctcctaaggagcattgggacctctgtatccatggtgacgctctctctcccgctctcgctccattctctcccgctcccagccgccatacggtccaccgggtggtccaccaggctctccgcccatcatggcaccacgtagatcgccttggcttccaccgtggctgcctcctcggcggtgtccgtaatgaggtggtggtgctccgggcccgccaggcatcatcctaccatagtccattgatcccccacctccatgagagggatgtgagtggtggcccataggaggcatgccaggcggtggtcctccgtggggtggtggaggtctagcctccatcattcgaggatcatcaaggtccatgttagacgacgagtccttgtaatgatctttcctgtccttgtgtcccattgggccaccttcctccatacgatcgcctggcatgttgtagccgccatagccgctgcctggaggaggtggagggccgccatagctcgatccaggtcttccctgacccatgcctgatgatgcaccgcgacttccgcttccagatcctccatagtgatggctcgagcccgcctgcgatgagggtggtggcgcatggtggtgagaatgcgaggggtggtgaggtggcatatggtgatgggcaggtgggggaggaccatgctgaggatgggtcccatgaggtggtggaccctgagagtggtgatgaagcgagtgcgagtgcgagtggtgcccaccgtgcgacatgctgccgctgtggatatggccgtgcgagtggggctgagttgggggaggcagctgcgattgctggggtggcaggccttgtccatagtgcaagcccgcggggtgctgagagtacccgccatggcctccgcttcccggaggcgggggccctccatatcgcatcatttcgtcgactccgtactgtgagtggtaatctgagcgacttgaactagagctgccgccagctctccgctgctggtgcatttgaagttgatgcatgtgctcgcgctgttcgtgctcgcgttgctcctgctcccgcatcatatggctgtccctatgctgtgcaagctctctatgcatcatgtggtctcgctgtgggtgctgcatcggcatctggggatcgcgtccgtgatggtggtgcgaagggccactctgcgatggatgagggggctggatcgcttgcgcgtgagagtgagacccctgctgagggtgtggtcccgatgggccatgatgggccagctctcgatgatgagaatcccgtggctgatactctttcgaatgaatctcacgaccctttgaaggctgtggagtgtaagcgccttgctgcgacaaggcctgctgatcttttgagctcagtttctgggaggaggtcaccgcgcggcctctccgtgctgctgatgacgcacccgctccatttcctgcgctgctgccttgacctcctttggctgacttggtgctaacggcttgttgattccactcagcttgggcattattagatggggactgggcggggtccaacggtgctcctgtggcgaactttcggctatggctcgcagcggttcctgaagagctgccattggtacccaatggactggagaagttgtgtgcagctgaggtcgtggtaacgcgaccgcttaaccgtcctgatcccgaaccaaaggcgtttgctgaagctccggtactccgttccaagaaggatccgttggcatcatgatggttgcgccgtccatcctcctcgtccgagtccgaaagttcttcgtctggtacaatcctggcgtcttgcaagcgtcctgatcggggtgttataaaaggctgtttagtcacggactcttgcgtgcatataacgatagtggtaacagtgggtcttcctcttacttgaaattctagtgtcgaaatcaacatcctcgtcttcatcatccgatgacgtgtaatccctaggaacctcttgcatctggactgatggtgcacagggaatgtggcgcaggttttctatgatttgagccctgagaagtaaagaaacgccagtcggttatgaacattattccaccgacaaatttcctcaatcgaatcagagcacgacttacttgagattatgaagatcctcaggagtgttatcgttcttcatgttattggctggcacgtccagacgatactccggtccgtagtactcgaaatatgagttgaacggaagttcctcaggaagttgttcgtccagaagcactgcagtctcaaaggtccacgctcttgcaacattgcggattgtgtaaccccctccgcctacaacgatcataggcactccaaaggacttcacataagcaacgcaattggcgtgtcccttcatcgacaggttgaagcatccgagtttatcacccgctagtgaatcagctccgcactgcaacacaacggctccaggtctgtaccactccataatgtgtttgatgacctggcatatcacagacgaggttacatcaaagcaaaggcaggttagaccaaggcgaggtgacgatcacaaaagaaagccagtgtaaaattccatcgtactgcttcgataacttacaggctcaaagaggttctggtacgaccagtcatccatgcccttctgcaggggcacattgacagcatagttcttgcccttgccaatgccagtctcctccagttttccagttcctggaaagaattcagtcatatggaacgaggccgtcatgacacgatccgtcgtgtaaaaagcctcttcgacaccatctccatgatgaatatcgatatcaatataaagtacacgctggtggaatctcagcaactccaagatggcaaggacaatgtcgttgatgtagcagaacccagaagcttcagtctttttcgcgtggtgcagtccgccagcccaattgatggcaatgtccgattctcctcgagtcagcttattagcagccgctaaaaaaagtaagcaaggctactgttacaaatttgcgaagaatactaaattatgccatcatgccgaacatttggcactgatcaagtgaagagtcgacttaccaatggaccctcccgccgagattgagcaaaactcgaacaatccgtcaaagactggacaatcatcgccaagattgactacacagcaagaatgacaggcgttgattaaccattacgcttcttgaaaacactcggttgatactgaacaagcgcttcaaggccgcaatcaaacaccgagttcttacagagatgcttggtcgactctgacatcccttcgccacccaccatatcaggcgtcagtcgatacaggaaatcgacatattcgtcgttatggaaccgtgtcatctgtcgagccgttgctcgtttgggacgctattatgatgagaccaaatgatagttgttatagtttcgctccaaagtgacgaagcatatcacgtttgcattgtaaggtccatcagtctccacaggcaggcgaatgtggcataacttacgatgacatccatcttcttatacagaccgtagttggtcaccaaactgtggcacattcgcactcgatgcggcttcatagggtgtcctacattagggggtgcatggtcagacgggagagaacgatattcgttagacgggcgcactgtgcagtcgaaaaacgtaatcttccgccgcacctgcagactaactcctgttagtatttttcaacaccctttcttaccaaggccataagtgtaattcccgacatcgtctaagagcacagacaatgcaaaaagttagcacccattgattagatccacgctcatgaaacatccgtggaagccggattcccgtcacaagggacgatccctgaatgcaatgcatatccgtgacagagccccctaccgtcgtaaaagtaagagacgcgctgcttctgcgtggggccaccaagggcaaatgaagacaacccggacgccatggtgcacttggttctcaaaagacagtgacagagacgctggattcaacagagagtggagacctatagcagtgaggaaaaagaacagacggcgccatgaggctcttgacaaagttcctggactcttttttgtttcgagggtgggattccttggacgtgaaaagaagggtgttgctgggcgaggggtgtttacctgcccttgtttcgtagcaggaacaactgagtctcttgaagtcggtagaaagcccggggtgtcgccgtcgaggacactggcagttacgggggcaaaggacaggtgcgtggaagggttgcgggcggatgggcgggtgatgtcgatgagatgcactgaggagagaacgcaactgcattcggtggggggtggaaaagcgagtcgcgggtggcttggcacaggtgaaattcactcgtaccctttttttttttcttgggacgcgcacccttttttttttctcgagacgcctttatttcatattgcaagtgggatggatgtatgtacagttggaaggcagagagtgtgccgagttcaaaaagggtatgggccaagagagaccaaaggagcgggcacattggaccgaaaggtacaggagggggcagcctgtgcccgttcaaaagggcgtcgcacggtgccctcgcgtgcggcactgtgaagctcccgtgagtgatcggtggatgtgcgagcctgaaccgtatcattcgcgtagctcgatttccatgtcggatgcctaagttttcaaaacagaacacaagcgtttagtcaacctgtcccagcaaaaagtacatgtagatatagaataagaaggatcgcaagtcaatccctcaagcgcgaaggtttgggattgacgcacacaggcggggatggaagcactgctgaatgtttgtgcgcgttcagatttgggcatcgcaaggtgtgacaaggaaacatctctgcaagttgagagcgagaacaatggaaagaccacaggacgagcaaacagaaaagggcgaaaagagaaaaatcgaacaaaagcgacggaggcagaagacgtaccgagtcataatcctccattggctcgccaagattaacgtgcaagtctcgcactcggttcttcagctcatccttttggttcaacagtcgatggatatagtccacagctatagagtttgagcaaacgaaggggagagaggggtcagccttcacggtaaagttatcgagtgatcaatccaagaggtgagcacaaaagttgaaaagatggcgcatgggcaaggaaaaaaaattgaaatgcataacacacacatacacacacatacacaacatgcactcaattgtcgcccttacatttctgcaatatgagtgcctcgctccgatggcactcactcaacgtgggaacaatctcaaccaacgaatcgaaccccacccgaatattctggcgacgcttttgctcagaggcgatatggtttgccttcttttcagcatctgtcagcaactcgtgcggcggtttctttgacctcggctgcgcctggtttgtggacgggtttttggttggagacaatgtccttgaggcgtcctgttgatgtggctcatgatgagagtctgctccataggattgtctgtgcttcttggatgagatctggccgtgatcgatgctttgattgtagctcatacccattccattgcgatcgtcgttactgtcctcgaaatctcgaccattcacagcaaacgatgatgcctcgcttgtttttcgacgggccgtggcatgatcgtcccggcttggacgatgagcagaccttgttccagggctggaagagggcgaaaattcgctggacgaatacgcggtcgatgatcccttgcgctgtgctgatttccttgaagcattcgcagacgtctcttcgccgctgtagaggtaactatgagcagtctcatgaatgctcggtgaggacgagtaaggtgcggacgctggatgttgagctgctccgttcgaaaggaggattggcggaggggaggtgctaaattcctcgctgctgccgtttcggaggagggtatgggttgctctgtttaatgatgaggggtcgcctgtgggtgccgagtggtcagggtaagctgcttgatattgggtgtgatgctgtcggtaaggctggtagtgttccccctgagagtactgctggtaagaatgttggtcgtgttgcatcagctgctcgctgtggtgctgctgttgtagccgctgttgcaactgctgttgctgtgcaagagccatggcctgggaaattgccgtggcctgggccatcagttctggattttgaagaaacgcctggctcatcgcgtggggatcgattatccctcctggtgcgagaagcgggttagagcccacttgccgagaccagtcgctgtgttgctgctgctgagccagcatggattctgaacccaggttgctagaagtggtcaagggtgtggatggctgctgtagctgccttgggtggtgcgaagggtgctgctgggacagggtggactcattctggtacttgaaccgttcctcttgcgccagctgaccaaggaactgcgagaacgccttttgttcgtggtctgacaaaagagactgaaaactcataggagtgaagcgcgcggactattatctattgaggaggaggagaaggaggagaggagaagaaggaggaggtgcggtcatgagtatctcaccattgtctcaggttcagaaagaagaaaaaaaaaacgagagcgagtcgacattcaggaacaggaccaccgaggcaatggcaccgagaagggaatgaggggatgggtcttttcgtcaccttatttctgttggacaggacagtgagacacgctgtgtgttgtggaggtgcagaggaaaagggttgaacgtgcacgcagggggcagagggcggtcgtggagaaagaagatagagagaggaacaaaggagaaacatggactgtggagaagaacatctcgttgtccgccgtccgctcagctctccacggactgagcgaacagtcgattgcccgtgtggacagagagggaccaacgagaggggcgcacaagaggtaccggagcaaggatacctccttggttgtagaccataaaaatggcgttagtatacaaaccttctctgcctattctctatagtgtgacttgtggaggagcgagcagatgcagatctcgcagctattactcagagcacgaacctttctctccctgtccctctccctctccccactccacgcatactgtaccctgttggcgccgcgctaagcgagagcaccgcaagggtcagtgtgtgtaaagcctgcatgtttgtatgcgtggatgaggaggaggagacagctgccttgacacagtgatgagagaagatctgcccaagtgagtggcgtggagcgagcgactgcgagcgactgcgagagagagcgcgcgctgcatgcatgtatcagagatgagagcgtgttgtcgctgtttcgggtctgtttcccgccactaaacacgtgtataggcacttttcttcccatgccccaagccaatgcagcgaaggctcatcgaacttcgctgtgagtacgatgctagactgacgacacgaaagtgcatacctttgtgcaactggtgaaggagatatggacgagggtaacgaattgcgaaaaaggagggacattttgctggtgtgcaggtcctcttgattcgttgagctcagttgaccgacggccaacctgaccaggccggcgactgaaatacagagttaatgcgaagattcgaagagcttttgctccggaagaacagcccgcgtggtccggctcggcgggaaggtgtgccagcgaggtccaactatgggttgctctagcatcgcaacccagcagcctgcgaggttaagagcactcgcttgtgtgtaggccactgtgtccgcttggctcacagtgcccgttgaaaataaatctgtcgaagcgcactgacaccaatgggggtcgttgtgtgcgtggatgtctgagtgtgttgagtgagtgcacttctttttctctctcgcctcagtctccattccatacagaccccacccacatccacccaatggatctcggtctagaacgcgtcacccgcttgctggaggctctcgctccatccgcctcgctcccaccaccgcacctcgccatccccatcattcacgtcgcagggaccaacggcaagggctcgatctgcgcattcatcgcttccatcctcaccgcctcgggcttccgcgtaggccgctacaattcgccccatctaatcacccctcgagacacgatccaaatcaacaaccagcccatctcccaggaagactaccaatacgtgaccgacctcgtcaagcaaacggatgcccagctggacctgaaagccacgtcgttcgagctcctcaccgcagccgcgttctactggttcgcctatggtcgcaccaacagcacagtgagccccagcgtcgacggacacagcatggccgctgtcgactttgcggtgatcgaggtcggtgtcggcggcagactggacgcgaccaacatcgtgcccgcccccaaagtctgcgtcatctcttccatcgacatggatcacgcaggcctcctcggaagctctatcgaggaggtcgcgttcgaaaaggccggcatcatcaagaccaaggtcccagtagtggtggcacctcagcctcagggccagaaggtgtacaaggtggtcgaagaaaaggctgcgagcgtcggattacatccggagcaggttgtcaaggttcagactgcgcaatgggtcacagagggcggggcacccttgtccaccggatcagagccagcgggtccaggacgctgggcgacgctcgaggacggatttaggttttggatacctcttctgggcgactttcagctcgctaactctgccaccgccatcgcagccattcgctcattgacagagtctgcaggttctgctggaggcaacgatacaaagctcgatatacagtggaaacacaagatcaccgatgaaaccattcgccagggaatcagagaaacggtgtggccaggaagattgcagtggatcaagaccgcagatgcaccacgagaggtccagggaaagatgctaatcgacggagcgcataacccagcagccgctattgcactaagcgcctacgtctcagagtatacagcttccatcgcacctacgacagcaggatcaggtgggccacggacacactggatcatggcattcacgaagggaaaggacattgaggaaatgtttgagattctgttcccaccatcgacaggccgtgaagaacgcggtcaacaaccagatactttttcagctgtggagttcagtcctccagagggaatgccctgggtgtcacccatccctgcagacgaggtctgccagcggctaaaagcacaccaggagcgcatccatatccaggaagggagccaactaactgtacaaggctttggcgccaatctgaaggctgctctgcagtgggtagggaaccagcgccaagagggtgatctggtggtgctctgtggatcgctctacctcgtcgcggatctctttcgtctacaatgacacagcaacaattacgatagaagaatcttggaatgaacacctccgcgaaggatcctgctttattatctcgcatgcttgaaatggggtggtagggttgtgatgtcgaatacaaatgcttatgcgcgagggttctcctcaggctcggcctcggccaaaccctccttgaccaacagcttctcgagctcgccagactgatgcatgctcaacatgatgtcgcatccaccaacaaattcgccgttgacgtagacctgggggatggtaggccaggaactgcgcacattgcaaacagaacaaaagaaggaaggaaggaaagaaaaaaagatcacgcatgaatgagacgtctagttcgccactgtgtctccaagcgcggtcgtgatcctggatatcgcgttccaacttacgagtactccttgattccgctgcgaagctcctcatcggccagaatgttgaagctcttcaacgagttttgcaaatcaacgccttaagatgaataaatgatagtcagactctcattaccaaaaaaaaaacttcacacgggcattttcgtgacagaaaaaggccaaagtcatggttaccttgagcgtcgaggatctgcatgacagcgcgactgaatccgcactgtaaatcagacaagtgtgtaagtacgggaaaaaccaaacagtcaaacaactctcaagtcagagccctgtgaaatagggatagatctcgcctaccataggggcatctggggttcccttcatgaagacaacaagcttgttctgcgtaatagcctagatgcgataacagggcgggagatcagtttgtggccgccagcaacatttgcgcggtctgtatgtgtgcgatagggacagggctggtcatgctgagaacgtacatcctcaatagtcttcttggtagagtcggacaagtgacggacagcaaaggcggtggcaggcagtgcggcacgacgggtcaggatgtggctgctggggcgaagagcctggtgtagtggcgggaaggtatggattgcaaagtattagtcatcgagtgggaatccttgaatctcaagactgcggcccgtctggtgatgttcatgctgcattttctccgtttggtgttgcagcagcagctgccctgtgtagcataccgaggttgcggagcgaaggaagttcatgttcggcggaatgtgaatggtaagtgcgggtgaagtgtggagtggagatcacggattgtttctcgggcgcacagtggcacagtctttaacccgggcaaagccacataaattcaacaccacttcttgttctcacatcgatcaactccttcaaaaagaaaaagactcgcgctcagcttcgttggtggtacacaccctgcaccgcaaatagactcggagtcaccttggattacagtaggaatgcgcttattattatgtattctcaaacaaagaaaggggtagtgacatgaaggacgatgcaggggatcacatagaaaatcaactgaactcgacgacagggaaatcatgaccactccgcgggacgaagggaacggagagtcgcgcccttgccatccgtcgaaggtcggctcccataatcagcggcataactactggctccttcacccgacggcttggcggctggagttggtagcgagagatctatgctcttcaactcccggctattcagcgtttttggacttcctgacgtgtttggatcacggagaaccggagcgatcatcgcatcgccatctggtccaaagaggtctccacctcgcagtgtgcctgattgcagaatgggagagtcggggagcgcctgtggattgccatagctatggtgcttggatgcgacggagcggtcgctctcgactacagtcgtgtccaacgaaagtggcgttgatgtgggtccctctctagccttcatggcagacagcgccgccgtcgcagatgcagcagcagcagcggcgggggcatacgcttggtagtcgacatcagaatgcgcctcctgttgctggtattggtcttctggattagcaacccatagaccagcagcgcccagatagccactgggatgctgaccatcctgctgcccgtcatgctgccaatttggatcgtaaagatctggctcattatagtatccaccgccttgatccacgccaccagcaccattgtacataagttccggcaagttctgatcaaagccctcgcgacccaagcccatggagctcgctgtcgcgtagtgcgctgctgtaggatcttcctggaagatggtggggttgaggtggtgttgatggggcgaaggggtcgcatagtcatcatatccaccattgctgtaggcgacgttgtgcgcgtggtgtggggttgggtacccggctgtagactgcatatcgtaatcgttgtagccgtcctcgtatccacccgtggtcatgctgttcagaccggcaccgccactcataataggacttgcgccggtcaaaaaattgtggctggctctacctttggacacgcctggtccactcatgccctgaagcgcgtcaaacgtgagctcgcggttgttgcggcgccttcgtctatagcaaatcacagaggtggcgactatcacgataagggccaagatgccgacaatggatccgacgatagccggcacattggtagaggaggacgaggacgatgaattgttgttggttggatgtgggcctaacgagacggtcgtgctgatgggaggagggaaggggttgggagaggtgttagttggcacattagtgggcgcagggttgctggaggacggcagtgggtcggaggagacgggtgggacggtggtggcggcagttgtcgttgacgtcaaaggaacggtggtagtggtagtggtagtggtagtagtggttgtggtcgtggtgtgttctggagttgcagatgggctcgagggcgtcggggatggtcgctcggtcgtgcgctcagattggctaggggagacttcctgagatgcaggtttcgagggttcgccgctctaatttccgcggcaaagaattatcaacaagggtcagaggagagatacatagcgttggatctgaaacccagcctgacagagtgcgtgttcgatccacagcccagtgtgaacacagagaattgcagtgtctcatcgccgacactcagaaaaaaaaacaggggcagcagcaatttctttttatacctgtgcttggactggaacccgcaaaagggacagcgccacgaggagtgagaggcaagtggatgcaaggtgcatgttgtgggcgcaccggtggtgaagatagtggtgtgtggctggagatgatgaaccgatgacagggtcaagaacgagatacagcaacggctcttatagtaaactagctctttcaaaccgataaacgataaagactaaactggccaagatctgcagcacgagataaactgaccagccgggaagaggaaaagaagaaggagcaagtagtaaagtgcgggtaaggtaaaatgcagtgtgaacaagacgtaaagagaggaagaaagtggaaggacgaggaaaggtggggacggatcaggaagggacctcaaaaaagtcaaacgacagcgcggcgagctttgagctgacaaacagttgctttgaagtcgcagccgatgcccctgcagcctgtaggaggtggtttgacgactgttgcgggaagggtcaaggaacagggaccagggcaagggaaagtggaggaggagggcgagcaggagggcgagaaggaggaggagggggagtggcggtggcggtgattgggcgagcgacggacgaggaggaggagagagaaaggaatcgaaggaagggaagaaaggaaaggccgacaaggatgcagagaaaagagaggagttggaaatgacgaaaacagctttttgctacagtatatgctccttgactgttgcctgattgtgagtgtcagagttatatgaagcttgacagcgtgtgtgcgcgaagaatatggatgcagcacaactctaaaacgatatcaaaaaaaaaaagagagacacccgaaggaaaggggggtggactgaaataggcaggggatggggtccatgaaatttaaacctgacaaaacacacacgcacacacagatcctggccgtcactcagcagggaacttggatataaatagctcttctcggccaaagatgaatgaacatggctagatggacaaatatgagcgcatcaatcgagagtccgtccttcgagttctgcccagtcagccagtcagattccaacagtcggcgcctcatccgcccaacacatttgctgttttcatagaagtagaaccccttttcacgaacaagtatggctttttcatactacggctgcacgcccacatgtctcgcaggctaaagatactgctgctgggaccatacatcattccacgccacgcatctccattcccccgagtatcacactccacgtatacacatacgtttccaattatttttattggcgccgcaccgactctcgatcttcgcgcgccctcataagctgcctcattttaaccgcgcctcaagtgagaggttttgttgggtgcacaagaaaaagtgtcatggcccaagcacacatcaacaagagacaactggacctcgcagatccaagcaaaaccgcccttcggcagataatgtgaatacatttcggttggcttgatttcgtgcctcctctgagctgagggtattttttgggcaggagcaccccaatggtgcggactggccggctgacggctctccgagcattgcagcaatgcctaaagacgtggtttaaagcgacagctacttctgcttttatgtcgcaaaaatattgcaatggaagcatatgcgcaatattcatcatgcacggctctcatgttttttttgatgctggttgcaggcaagggtatgcacgctagtctaggtgtgtctgagctcaaaatatctaaaggatttccaagacctccttcgcgatctctgcgtggatcttcttggacggatggaagccatcccagtagaagtgcttgtccgcgtccttgcacacagtcttgtagtcgttgctcacgcatccatgaatcacatccgtgatacccagcttcttgagttgagaagcttgatacagtcgtttgaaggtctctcctagtctcaagtacttgatgctgactgttgtttgatcaggcttgatgaccttgcacccacggaacggctgatcgcgctctaaagcagggccatactcctgagcaagcttgctctccaatcctttgtagtccttttgctctttgcctgcgatggctgtgaacgcggcggcgttggcgggactggtgttgaagtatggaatggcaccatagtcaaagttctcgaccacaagaatgttacaggcacccaactgaaccagcttctgaattccttggtgaagcctgtcaaggacgccttcgggatcgagtacggggttgaagaagaaatcgttgccctggaagttgactacgaacagcgtttttgctgcttcttttttgttggatttaggctcatagagtgtttcgatttgctgaaggaaaccagggacggggatcgtggacgctgggccagtgtatccttgaacgagtgtagagtcactagtggctgcagcgtaggcgtaggtgctcagcttgtaatgcttcttctttgccacctaggccgtgatataaacaagcttgtaggttagccacaatagatacgagccactgcaccaagacggaccaaaaagggttgcttactgtctcagaccagacagggccgttagagaagcggccgcgataatacgaagacagcggccaggtcttgtttgagagcttgtagacgttatcagtgtccgagtacgagtcgccaaagacgacgaggttctttatctgagcaccatggagaggccgagcgactgctaatggaagggaggaggcgccgagggcgatagtcgcgatggcgagaaggttgatcagcatcgtagtgctcacgagtaacagtcaaggccgggaagttcagaggaggaggaggaggacgaagaaggggaggagaggatgaggacgaggacgaggaggaggggagagcagacaaaaaagtcttcttaaatgctgggtcgcacaattattattagaccggtgttgattgctcctctggcgtggtgtggcagtggacagtgctagcacgactgcagcaaagggtgtgagggggcgatggaactgaatggcacgcaggcgtggacgacattcacgagctgaggaatcactgcgagatggcacaccctgcgcagagagagagggagagagagagagagagagcgagcgagcgagagcacaaagtctagaacgtttgtcttcttgtttctgctcccaatctatcccctctggatcaatgcacgctgtggctataacgctcgaatcactccgccacacgtaaaaagggtctggacatctttcccttcccttacttcggcgcaatccttgtgagcaatgaacgtgtgctgcccgattttgcctctatcgcgttgtctagtggctccagccccgtctctgtgtgctgcagatggactacaatccagatgccacaacacgccatttctgggtactttgttgataccaaacacacattttattggctcaaagcgtgtcaaggacgtttcttctcttgcgtgtcctgttcgtcctgatgacgcgtttccgcagcgttggccgattgtatagtttccagaagcgccgccaaggttgacgtgagcagcaactgctcatctcttgcgccgtctgcgtttgctaccctcctcttgtcctttccatcagtcgccagagcgttcttcacatttgacccatcctcgaatgtgcctttttgatcacggtcctcggatctcttcgacagtgcgtcgtcgccctcggacgaccctagcaacaaacccagtatcgactccatgtcaagagtctgcttcctctgctcatcctcggaacgctgcagttgctctagtttactgtcgatcatatcctgcaaattctggaatccggccctttggctgtccgtcatgagtgctttcaaactatcaatgtagttgtcgaccagaattgccatctgatccagttgcttgctaccctggtcacttttcccatgatggtccgacggaaccatctttttcttggtttccaacggcgagccctgatcgtcagactcttgcttcagtggttggggctcttgttcctctcgttgctgatgatgcccaatattggcatgagcaccactatcaattgattccgggggcgcgatagaagcgtagtacagatcgtcagcgacaatgcgcctgcaatcgatgttgttgacgtctggcaccggaatgttttcaaacgccacctccttgcacaaagacggtgagtagatcagcatgatgtagttgcaggttgatggctccgacacgtgctgaatacgatcgtctacatttgcgcattgaaactagttgccgtccgggattgaatgaagtggcgtcaatacaagtgcacacaaatacagcaaatgcagaagcgagcatgacgttccatacccgaacttgaacttttcgaggcgcaccggtaagatcgcagatttcaccctggccccactgctgaacgagatacttttgttcgttgctcactgccaattctgttacagtgccagcctgtgttgtggaagaggatgaggatgaggaagatgaggaggaatccctttgctgaagtgaaccttcgttgttcggatggccctggatttcagctgctggaggttgatacagcgccaaggtatgcgtcaatgccgcgctagctggcactaactggccgttctggatctctgcgtggaactgtcggatgtgctttttgtggcagtactcgtatgtccagtagtcatgggtctagcgaagggataacgaagttgcataagcgaactgggtcgatagtgatgcgattttaacagagattatcgttgcaactgacgtacggttcggagacagtgtccagtaaggtgatccaacagttctagacctttcttgacactcatccgatcctgctcttccatttcctgggaagttttctttggcggtgtcttgacgtgctgaacctgcttgggcggtatggtgcagatccagcgctgacctcttacgtccggcataatcatgctggaggcggggctcgagaatacacgctgatgaccttgagagtgctgcgtttcagcgttttcgggagtgctctctagcgttgggctgctctgatccggtccttggccccgctcgtcgaactctccgcttgcggtgtcaagctggggtgactttgaagaggtctaaagcggtaacgcgagagggtccaccgttaactctgaaaaacttggcatgaggcggagggggtgtgatacaataagggagctataccttgcgatggtgtatgtttttcctatggagtgcctctgtgcttatggaggatatgggcaccagctccttgaggtagcggacatggtactgggggtgggccaggaggtcgttgtagacgaatccgacagagtgagaggctacgagggcaggcagtgcggcgagggtgatggaggtgcaggccaccagagcagcgtgcatgggcgagatgtccctgagccgcattggacaagaggagtgatgtgaagaggggatggatgcaactgacgcttgatgcaactgacggcagcagccctaaataagcaccctggactggcaatttgtggtgcacgcccattggagaacatgttcgctgtcactcctttctgcatatcatatccagcagacacctgcttcattccccggaagccgtgagtgctggcaacgacggcaacccttgaacccgcaagcagacaagcatgggtgccgcatgctcgccgagtgggtatgaaggcaggtgggcgaggagggacaaaagaaacgcgttcgagcagtcggccatgtcaattaagggtcgagacgggtcaagacgaggaagaaagaaaaagagactttttctgtctcctctcctctcctcgtcttcatcaacaacatccctttgctccgcctggtcccatagcccctctcagtcctttctcgtccccctgttctcccttctatagtggtggattcgcctattgtcttcactagccagcctccagttgcagcccatccccgaatccacaagaagaaaaagccctccctctaggaaaagctcactgggatccgaatcctctctcgctccctcatctctttttctcccttcgttgcctgttgtcagagtctagtcacctcctcagtatcattcactctattgttcacgcgacgacccgctctcttgaattagtcactagagcatcttgagtcttttgattcgctttgatctttgttagctttcctttgtattgttatatctattacctgcccccccccctatacactcttcatcacccttccccacacctgtcggaccactgccgaaataaccactcacttcaggcggacattaatggcggccaaccaacagcacatggcgtaagtgcatcaggagagtgatgtcatggatcatgccattgtgagcccatccattgcttcacgagacgcacattagctctgctatgaaaaatgatgctgacagtcgctagctgtgtttcgcttatagccacgagaatgatagctggaagaagcagcttaccctgcccatgaaagacgagcggcctcagacagaggtatggaaagactatacgcgttcgctgcacgagtgtatcaggtacaggcgaaactaacacaatgcatgcttcacgtaggatgtcactgcgaccaaaggcaacgagtttgaagactacttcttgaagcgtgagcttttgatgggcatttttgaggccggctttgaacggccctcgcccatccaggaagagtcgataccgatcgcactcgcaggcagagatattcttgccagagcaaagaacggcacgggaaagacggcagcatttgtaattccctccttggagaaagtcaacctaaagaagagcaaggtccaagccctgttgttggttcctactagagagctggcacttcagacggcccaggtctgcaagactctgggcaagcacatgggtgtccaggtcatggtgacaacgggaggaacgacgcttaaggatgatatcatgcgtcttagtgagacggtccatattattgttggtacgcccggtcgaatccttgatctcgcaggcaagggcgtggccaacttcagcgaatgcaccacctttgtcatggatgaggctgacaagcttcttagcccagagttcacccctattgttgagcagctgctcacctacttccccaaggagcgccagatcatgctgtacagtgccacattccccatgattgtcaagacgttcaaggacaaacatatggtcaagccctacgagatcaacctcatggacgaactgactctgcgtggagtcacgcagtattatgccttcgtagaggagcgccagaaggtgcattgcctaaacacccttttttccaaggtgaggcggtcaaaacacattgcgcctggtgtccaaacgaaggtccgtgttcatacgcaaagtcaggaactaaacctccttattctgttatttttctccaccgaaccgacagcttcaaatcaaccagtccatcattttttgcaactcgaccaaccgtgtggaactcctagccaagaaaatcaccgaactcggatactcgtgtttctattcacacgccaagatgcttcagtcgcaccgcaacagagttttccatgactttagaaatggtgtgtgccgcaacctggtctgctcagatcttcttacccgcggaattgatattcaagctgtcaacgtcgtgatcaactttgacttccccaagaacgccgaaacgtatcttcaccgcatcggccgtagtggccgctttggtcacttgggtctagccattaatctgatcacctacgaggatcgtttcaacctgtacaagatcgagcaggaattaggaactgagatccaggccattcctcccgtcatcgacaagcgtctgtacgttgccccatcggcccttgaccagaatggctatgaggacgagcagcagcgccagcagcaagctcatcaacagcagtcccagcagcagccggctcagaaccactaccagcagcaccatcatcaacaacagcaccagcaccaacatcagcatcatcaaagatcgcagcagcagcaattgcagcatcgacgttgaatgcgttgttgttgaaacaagcgcgcccaccaaatcgggtgggatttttttttttttttttttgtggttaggtttttttggcaagccaacattgcacaaaagaacctggcactttttctttttttttttgttatcaaatatcatgccttttttttttttttttgttgaacccagtcaacgtctcatgtcataaaatgcagatccgcggctgactcggtcgaaaaccttattcatgactgggctgttgacttcaaacaagttcagagcgcacgagcacagttaaaacatacttttctctcggctctcatgttcccatgccgacttacccttccaacgctcgcacaatccttttcaccgtcttactatttcacactctcgctcccactgtccttccccttctctcaccaccattgccacactctcacccaattgcgacaactcgtctctcgtttcttcgaaactacaagcgggagacccctcctgtggataagcatatcgcgttagattttcaagtgtctggcgtttgagggtccagatgggagcaaagtttatggactggtggaagaagacggtgtgtacgtcctagtccaggccgaaactgaggcccactcttggaagtcattacaatggaaatttattggtgtagccttaccattgaggttcttcacccttccagagggcgatatcctatgcatcctgaataaagcaggcgagtttacagctatgggtgcctggaacctcaccagctcttctgttcgcaggacccgcggatttttgtataacccatacaaccccgacccgtaaggaggcccgccttccactcgtgcatcgtggatgcggatcgatgtggcatcgaaaaccgaacccgatgggaatgagattgctcaactcatattggacactggagaaagcagctcactgcaggttgtcttggaggggtcgcgtctcacattcaggaatctgactggaagtggactcactgggcgtaacttgcacgatgtacaacagtggaatatggtactgttccgtactcgtttggctattcgatcctatacaagcccaaaagcacaagtatgaatatgtacatcaacttagtcaagtcgagtatacttcgagagcaacgctcagcttcgatactccaacaattttttgtacatcttcaacgccgacaacaataatgctgcgtccttgatgaagatccctttcattccatcctcaggtctgctcaagtcgcccgatgtcaccaagcttccactcggaacgacattgatagaaatcacttcgaccatcagcatgtgcgattggcaagagggctatttcactgcagtttcaggaaacgagttcttcctcctatgccaggtacagcacctataaaaaaatggttttggagcttagagcaaaacggccgcacctgaaaaagttgcggaaaaaggactcactcagactcttcaaatgtctatagaaagtcgtaggacttgacccatcagcgaagtgggaaaagaccctttttgtctactataatactgatggcaaccccccaagctcggcaagccactgctattgaccaacatcgatccatccctgaagatccatcttttcagccgttcaagaatacgacctctgcgatgctgctttactcgggagcgtacagctactactggtacagacacgccgagctggtgctcttaggacccgatattggcacgaccacttgcgtaggagtgagcgacttaagcgtctcgcatgataccctgttcaactatctgccacctggcgcgtcagaaccaccggtcccgcagatagatgggattccgttcaatgaaggcttgataggcggagtaatcggtggattggcagccttggccatgttggcatttctggcactgcgacatcgacgacagttgagggatcaggaacgcgcagacgctttccaaaagtttcaaggccttgaagcgcatgctgtggggaaaggcgcagcgcaatcacgacaggccagtccattattgtcgccagcagtatatgccgcgccgcaagcatttgccccaacttcaccggccatgtcggcaggaatgccggtgcctccacgaccgagctcgccgcctacaacagcaggagctggaccgtttgacggcccgacatctcgcacgacgtccgaatctccgaccgctcttacttacgagatagagcttcagcagcttggtttctcgtctcatccgcgtccaaactttgtaaccaccgtgaatgactgagtcgcggcgggtttagatagagtctgtagctgttgcttgaatataccctaatggagatgcggtttcagccaggaccaaaagagtgatgtccaagggacaacctacagacactcgacctatgtcagtggatcatcgtaccttgatcctgcgctcaaccatcgaatccgttcaccgaaccacctttccctttttttttcaagaatggccagaatcgtggcgtcctatgctcgttgagcagaatgtaggcgattggtttctaggaatctccttccgcgccagcgcttgcctcgactgctaaacaggtcgacaatccagtagagttagagtttgtgtgcctcggtcactgagctttggctcctcgaaactgggctgttggttgatgtgttttttttgataaaaatgcgcgcccaaccccgcgccttcgatatattttagctttccctctactttcactttcccccctcgttatcgttccctctctctctcgctctctccctctcggtaacactctcgctctctccctctcggtaacactctcactctctcactctcggtaacactctcactctcactctcgctcaaacccacagtttccaaagcctctgttgcgtctcacgcatactcctgccacctgaagatccctgctcactccacaggaattgatataccccaagacatgtcgtactttaatcacgatacggtgcatgtggacctcaagtgcctagttcttagcggatcagacgggaccaaggcctatggactggtgaaaactagaaacgtacacatcttggtccaagcccttattccagcaggtgatcctcaatcagtgcattgggaattcgtgacggccggctggtctttccaggaattatacgacctgcaaggcgactctgcctcgtgtattatgaacaaggcgggcgagctgatcgccatgggaccatggaccgggattcaaacgagcaatgatcgggaccaacgcggactcgtgtataattcatttaacccactcccagtactggaaggaaaactcacctccaacgcatcgtggatgagggtcattctggctacgacgactgacaagtaccagagtgaatgggctcagctcatgatcgacaccggctcggatatcaacagtgaacgagagattgccttgacaaaatcgcagatcgtctttcggtacctgaatgtgtttgacaacaggcgtgagttggtcaatatgggagcctggacgttagtaagtggagaaaagtggtgcgcatttttactttttaactcgttcctgattttatttcaatcgtctcacgccaacattccctgtctcttcagccgcgtccattaaacgattcaagcacagcgcaactacagtactccaacaactctctatacgttttcagcgctcatgaggcaaatgacacgtcgttgatgaagatcccgttcaatccaagctcatcgatcccaaaccaacttcgccctgaacttccaactggaacagcgacgatcgacatctcctcgaccgccaacaaatgcgcctgggatatagggtttaccactgcagtctcggacaacaagttttatcttctttgccaggtacgcatgtcaagaagcgaagaaatggaaagaagccgatctcttgattgaaggacagaggattaactctattatcggttgttctggacagaaaattgaaatgggaacaatcgtaaggagcctcttcgtctatgagaacacccctgacaacaaggatccagcgctcggtgctgcagtgccagtgaacggaatcgacccatcatgcacggtcaggatgttccagccggtcggaaacaagacatttgcgatgttgaactgcgagatgagcaataactatccccagcttgtcctgctaccgctctcgggaccttatgctggcaatgccacacgtatgtcaacagacacaatccaagtctcgcacgataccctcttcaataacttacttccatcgcagggagaaattagtggcaggacagataatgggatccctcgcgaggagggtataataggtgcggtgtttggaacgttggccttagtcgcgatagcgatccttactcttcgacacaaacgacaagagcggtctaaagcagcactccggaaagacgcagaggctatgccaggctcatacggccttgagccgcttggtgcaagcggcgttacgggtctgtcaagccatccgtcgtccgccgtaggactggttcaatcaacagaggcgaacacgcatttatcacccgcagtgtatgcagcaccgcaagtcgccaacgcactttcaccagacatgtcggcaggattgtctgtgtcttcgtggcgggcctcaccgcccacagcggccagtagtgctcctctgtcatcgacaaccttgtcaccggcaccctcagagggttcaccatctgtacctacctcgggatcaccgccagcaaacacttatcagatggaactccagcaacttggtttctcgtctcatcctcgtccaaactttgtaaccaccgtgaatgactaagtcacggctgtcaaagacaggatacatgctcgtgaaaaacaccctccataaacatgcatcttgaagccagggtccgacatgtaaaaggtgcttgtgtggtccaagagtagagcacaactcgaacgatggtatcatagtgaatgcctgcccttgttggtagtctattgactgctaacagagccgacaattcatagagaaacaaaaaaagttaagagtttgtatcccctcgggaactgaacgtgggctccttagggttttgaatctgggctgttggctcgcattcattaacgcagtcgttcccatgagcatgcccgctcaacctcccccgccctttacggtctatcatacacactttcgttccttctttcgctcttgctttctctctctttctcacatgccctctcactctcactctcacatccctgctcgctccacttcaagtgcgaatacatctcagtatgtcgaggtcctcagattacgacttgctcttcaagtgtctagtgttcgatccattgaatggcggccaggcgtatgcgctggtgcacaattcatatgtgcccttcttggtcaaggcgatcattcctgaatccgatccccagtcattcacgtgggagttcgtgagcgcagcctggccatttcaaaactcctatcgcctccaaggcgacaccgactcgtgccttatgaacagggtgggcgagctgattgatatgagtacctggaacggggatccaaccactgaccctcgggcccgacgcggactcgtgtacaatccgtacaatccactgccaatagtcgaagatcggaaaacgtctaatgccctgtggatggaaatcaacacgggtcccaacatggacgacacggagaaagaactggctcagctcatggttgataccggcaccgagggtagcagtgctgtagtaattgccctgacacgggggcacgtcctctttcggagtatgctgccgactggattcaccactcgccaggtggccggtttgggatcgtggacgttggtgagtcaagaggcatgaatactgtaggcatttctgggtttcactttgatcgtctcacagcatcttccctgccacctttcaaatctttagccgcgtactctaatcgatggctacacagcgcagctgcagtactccaacaaatttctgtaccttttcagcgctgctgaagcatatgacccgtcgttgttgaggttgcctttcgacccaaggggaacgatcccaagcgaggcttcggatgaccttccaaaaggaacgacatcgattgacatctcgaccgccaacaattgcacttggactagaaacttttccaccgcagtctcgggcaacaaattttatcttctctgtcaggtacgcccgtcgatatgcaatgggcgggaagggagctgcaggagaaagaatacaaaagaaaaaaaaaaaggaaagttgacataaccgttgttttcctgcataggcaaagaagaattcaacgctctctacaagagtcctctttgtctacgataacacgcctggcgcccagagtccaaagctcagcgctccagtgccagtgaccggcatccacccatcgtgcacgatcaacctgttccagccgcttggaaaccgaagctatgcgatgatcggttgcaatgagcagctgtacggtacgacagcccatagtctgctagcgctctcgggatccaatgccggcgcggccacgcctttgggcaacacaaagatctggcttcagcatgatacactgttcaacaacatccttccagaccaggacgaaatcaagggcccgagctcggatggtgtttttcccaaggagggcatcatcggactgatctttggagtcctaggggttctggccgcgatagcattcctcctcgtccgaaatcgacgacgacaaaggtccatccaaaacagccagaaaggcgcggcgactaactctgatgccctcggcattaagccactgggtgcgagcgcccgttcacatttgtcaccaagcgtatatgcagcaccgcacgtctctatctcgccttcaccagcgctgtcagcaggaccccctgtgtcctcaaggccgacctcgccgcctgcagtagagcgtgctgcacctttgtcgtcaacaaccatgtcaccggcaccctcaaggggaagcccaccagcagacttttatgaaatggaactccagcaacttggtttttggtcgcatcctcgcccaaacatcgtaacgacaatgagtgactgagtccgccacggtcaagtgtcccatacactgttccttcccaaacaccgtgaaataaaaagggtccggcttccttgtacaaagataaatgcaaaatgccttgtgattgatatatcgtttttctaaaaaccgtgtccactaaactcgtcacttaatccatatccatgctctctgctgcggtcgttactgctgtcgccgatgggcctgcatctgggttgacccagagggtggtgccccacttggggtacactctcttgtctagaaaggatcaaaggcataagcattagacatttaaacaatgtacaagcgaccataaatttcacaactttcacaagagaactgccacgctgcacgagaacttacataggcacatcatgattgtgtcctgcatagaaatttgttgatccctagaaaacacgcgaagcaggaggggttagaaataatgtctcaactgtggatgtcacgtagagagcagtgaactgccctactcaaaacaagcctgaaacagctagacctaccactgagccttgaagtagccgtgagttcccagagactccttaatatgtccagtgcgaccaagcttggtgcgcagctccacagacttgtaataccacacgtcgtcggggttgaagaacataaaccggatcgtggctgtgcgcttgtggaccttgaagggatgtccagtcagaatgattctcttggcaacgattctcctgggatcagcgtccataagtgttcctgtggcgacgagaataggtgctacgaatgtgcgaggtgggagattttagttggcagactttggaaatcaacgacgatgttcaatcagtgagcaaatgtacatatgccaaatagtttcacacttacagttcacgtcctgagtatccttggtgaggacaacaggcaggttgccaaactgaatgggcgcgtatacagtgacgaccgtgctacggccatgctggaggaatcgttcactcttgtggacgttgttggagcccttgccgttgcgcgtattctgcgaaaagatggggttgacgacaaagcgtctgaagccgcagtgaagaaccagagggtccttggccttgatgataccatcgtattctgcgtcgcggttgaccaaaaagttgatcactcccatcttgtgctcatactgaagcagcccaaagacgatgaatgggcgggcagcagagtaggtatccatgacagccctgggaacattggcgatgtgcagggttatatgggtgccgggcaagatgcctccttctgtagcctggttcatgacacggtacttagtgcgacggaagttctcgaactggaagattcggccatagtccaggggaaggttctcataaggatcccaaggagaggttctgaacgactcgagggcacgataacgtgcaaagcggacctgcgctgggacatccatgggcgcctcgacctcgtcagggaactccatatcgtctctgttctccttctctctggcaaggtattctgcatactggcgggcttcctcctcgtcctccaattcctcctcatacacctcctcggtcttcgctggctcttcgctctcgacttcgagatcctcgtactcctcgccagagtcgtcctcgttccttgcgctaggaagatcgtcgtcctccatgcggtcatcctcgtcagcatcctcgtcatccatgtcctcgtcactctcgtggtccgaatcgatgatccatgcagcctggtagttggaggttcctttggggacacgtctgatcaccttctttggcgcagcagagttgaatgactgctcaggcctctcgttaggatccatgttcttgacgcgctcctcagcctccatcagctcctcctcggtgggccaggtctgctcgttagcaagcagatcaggctcattctcggcagccaaatcatcctgctcgccggggactggagcgtccaagacggtctcggtggcctctgcatccataccgttgccattgttgatatgaacagccttgtggaggacgggcgccgatgtgatcttctccagctgaaagtcgccaaagttctgcaagtggataaggcggttggcctggaaatgggtgcctctggcgtatccggtgacctttagcgtgccgaccgtggggttggcggggttctcctcaaagtcaaggctctcagccaacatgtaagggtgggtgtcgcgccaggtgatggactttggcagctggttggcgatcatgcggagaacgttgactgtctctgcggcgttgtccagagcgtgaaccttagactcctcagggaagaagtggttggtgaaggagagaagcgactttttgatgtccgagtgcttcttggcaggtgtagtctccaggttgctgacagctgcgaccaccgagggaactccctgcgactgaataccggacagaaccatctctccgaacttgtcgacctcttccacagctgacatcacaaagaagataaagtccgcgaccttggcggcatccatgatgtcgatgtagttgcgttggagggggacaaactgaagcttttgcttgaatcggtcagtgctatattaccacagacaatggaaccagggttggaagaagattagcctcaacgatccatgtttctgagcggaagagatggtttcgagcgagtggcggttcggatcaacgtacgccatgagaacagtgccgctgttggcagggacctgatccacgctggcaaagagcttcctgacagcatcatcggcgctgacatcggcgcagagagcgacgacggcaacaaccttgggggtgccgttctttccatcaaagatctttgtctttctaaagagctcctcgcgcttcttctgttggaggagtctggcagtgttgcggcggtcggtcctgttggagaggcctttggtcgactggtgcttgatggagacacgctcaaccttgcctagaacagtccgaggggtgcacgttgagcaggtgagtcaaagcgttggcggagagaggtgcagaagagtaaaggcgagacgagcgagcaaggaagcgtaacgaagaaacaaaaagtacccttggccttgtcgcgcaagctgctcttggacagatgctttgacttgaagggcttgttttgctgcttgagcttcgtgttggaccgatgctggtgcggttcagacatggtgggatgtgtaatgagaagagaaaagaaaagcgccactgctcagcctggtatggacaaaaaaaaaaaaaaaaaaaaaagttactggctgaggagtgatcatgttttgatttggcagcttagcagtcccgagttaaaccgtgcgatcgctggcacaacggagacgttttttttcttgcttcaggtgaactttcgtctctcagttgtggctccttgcacatcgccttaactgtcagccccatccacccaggacccacccctctcatcaacaacatgccaagcagaagcaggagccgcagcagagacaggcgagatcgccacagagacaccaagcccgctgcaaggtccccctccccgcgatcctcccgcgaccatcaccgagacaacgagcaccgcagctcccgaggtcgtgacggagaccgcgacagggaacgggaaagagaaagagaaagagaaagggatcgaggggaccgggactcaaagcgccacagagatcgctctcgcgaaggcagctcgcgtagagacagcgacaggctcgaccgaggggaggacaggcggtcgagaagcgacaaagacgaccggcactccagagacaaggacaggagctccaggaggcgcagccgggactctgaaagcggcgatgacaaggagcgtggcagagcaggacactcatcctcgagcaagaaaaagtccagaaaggatgacgacgaacccagccggaaaacacgcgagacctcggaggagcgagcgatcaggaaggcgcagcggaaaaaagaaaaagaggagcagaaaaagtcactcgaaatcgccatgaccaactactccaactctgataaccccttcaacgacgtcaacctcgctcaaaagttcacgtgggccaagaagcgcgaggtcgagaagaagaagggcatttcctctgcagaggcagctcgacgcgatgcagccaggagagaagaggccaagctggagctggaaaagttgacccaaaagagagctgagcgcgagcgggaacgggaggagagagaggaggagcttatcagaatgcagcgcgcctcagagcaggctcagcttggcgactggcaagcccaagaagaagagtttcatttgaagcaggccaagaggcgagctgagatcaggatcaagagcaatcgagccaaaccaatcgacattcttgccatgaatatcaagctgatcgcaggaaacagtgatgagaaggaggacgaggacgaggaagatataggcctggagatcgacgtcgaagagccctacacaatttttgatgtaagtcattcattccattgacaattcgtcatgttggcgaggaagctacgtgctctgtgtctcacccagctgtttgtttgctcatagaatcttgcgctggaggaagttcaggaattatcccatgacatcaagttttatctcagtctcgacaaggatgaaaacagtgtcgaattctggagggctatgctgattgtatgcgaggacaagttgagcgagatggatccagctcacaccgtgcaaagcgttgttgcaccccatattgctcaggacatcgcatcaaagttggcaggcaagacacatgaggagctcactctgctgcagggtcaaattcagcgaaaacttgctggaggaggcgccatcgatgtggactactgggaagccctgctgaagactttgatcgtgtggaaggctaaagtaagtggcgatcaaatcccatgtgtgcgatgacgggtctgatcctttttccatgcatggaacaaaatactcacaaaatcacctcttctcatcttgcttgtctgtaggctaaactcaatgcgatccatcaagtgatcctggagaaacgtttggagcagctcaagacgcgtcagctgcgagaggcagagaaagaaaaggccgaacttgccgccgtcttggccatgcacgctcaggaagttgcgggcgatattagaggcctgagggaactgcgggacgaggatatggagctggcgaatgaggacaacgataatgataccactggacttgtaactccagccatcgcatacgaccgtgccatgagtcccgagcctgtcgatacacttccccgcgaggaccagaatctagcagttgtcgaccaatgggaagattgggccgaaatcgtaagttgacagtgcgctgttgatgacggacctgctgttacttttgtaggcatgaaaactcacagggccttttatcatgttttataacagttggacaagcgtcgccaggttctcaataagcagttcaaccctaaacggcggaacgctgaacaagatactggagatcagcatcccgacgatgactttgtggccaagatcttgttcgacaaggaggctgccaaggagttgtccggcaatgaggagacattcaacatcgaggcctcattacagcgacagcaggtatgcctattttttacagaccccgatttgctttttaatagcctgcaaagaccacgaatgctcacttttgctccatcttcatcaatctagacatacatgtggcaagacaagtacagaccgcgtcgaccccgttttttcaaccgcgtgcatactggatacgagtggaacaagtacaaccagacgcattacgaccacgacaaccccccacccaaggtcgttcagggctacaagttcaatttgttctatccagatctcattgacaagtcccaggcacccacatacgagattatcaaggagcctggaactgaggacacggtgctcatcaagttcaagtcggggccaccctatgaggacattgcgttcaggatcgtcaaccgtgaatgggagcactcgcacaagaaaggttacaagtctgtgtttgatcgcggtgtgttgcaactgcactttaactttaagcgacaattctacagacgttaagaaagctagacaaaatacaatctgcactcgacaactttgcttcagtcagtttttatcgaattagtgttctaggatatgtagtgagagtgggggtggaatgagagtcatagacgtttacgcctattgctaaatgcgtttctctttgtctactgatacagaaggcgagacctcaattgtactcttgtcctcgctgttgcgcgcagtttcgacttcgccgggatgacctatagagtcactgcccagctcagcatctgcgccggctctggctccttcatgagcctgggacatggctgcaggatcgctgttaggggcgaggacgattgtcgcgatgagcccgaggccacccaagacggcgacactgtaaaaggcggcattgtatccgcgaagaagatcagcgcccgctgcggtggccgagttgcggctgttggcaatcacattcgagatggcaacaccgatgggggtaccgatctgcagagagacgttgtagactgttttcaaaggaaaccacagggtgtgttagagggaacgttttaaagatttgcgcaaagtcatatcgcccctctggagctttcaaaaaactgaaaccgagctcaccagcaccaacgactccttggtcctcatcatcagcatccgcaacagaaatgatctgacagcagagccagataggagccatgccgaggaagttgaggatcaatgcagggaaaggaatggaccagtacgagctatcagccttgagctgtgcccagaggacgcccgaagcaatgataaagaaccagccgacaatgatgatgatcttggtcctgaccacagtcaccagcttggtgagcaccacgacagacgcgacaagtccaacgccgtgaacgatatacgcaagcgaagtctttaaggccgtgtatccgagcacgttctgaaagcccagggaggaataaaagatcagggcattcaaggaggctgtgcagcagatgatcgtgacacaggatgcaacgagacgccgagatctccagatatgaaagggcatgatggggtaggcgatcttgcactcaatcacgacaaaggcaaccagaagcgcgagtccgaccaacagaggagcgagagtctgagccgcgccccagccaacagctggtgattcgctcaggtaatagataatggcaacgatgcccagcatgaagctgatgattccaaagtagtcgatgcggcgatcttcagctttggacgtgtccagtgaggcagggatcacaacaaagccgagacccgccatggtgaaagcaataatggccgtgatgtaaaaaatccatcgccagcctggaaatagaaagcaatagtttctatcagtttgcgcgcttccactgagacagcaacaaccccccttcacttctcttaccgatagtagagccaaggatgccgccgagaagtacgccaacgactgaacctacagctccgacgccaccgaagattgctagcgccttagtccgttccggtccaacaggatatgttgtggtcaggatggccagagcacttggaatcgtgaagcccgcgcccatgccttgcagggcacgacccactgacatgacgatcggatcctttgcaaaaccgttgacgactgcccatatggcaaaccaagtgactccgatgatgtagatgcgacgatgaccaaacagatctccaaagcgaccgccgatcagaaggaaagcgccgtaagcgagagcgtacgcggaagtcaccctggaaattttgggaaataaaaaactgtcagctttcttttgctgtcaacgagcgcaattgtagcgagaagacgcacatcccattcatgtaggcttaccactggagttgatcaaccttgtatccaacctgcttcatgatctctggtagcgtgattgtgacactggccacgttaatgatatccagcatctagaatgtgtcacacagtgtactaatgagtacatgtactttgctgccagggggagttgcagatatgcaagggtcatgctgtaattgtgtacctgtgccatagagaccaatgccaagagaaagcctttgttctgatctagccgacggtaccacggcagctgcggcttaatgtttgatgataaatccatatcttttgcccgaactttttcaaggcaggaaggaagaatgatcaggaattgggatgcagagtggcaacggggtcacgacagtgctgaaatgggagaagaggtgaaagggcagaggcgctgttattgctattgattttaagtgcaggcgaaagcttttgtgaacgaggaactgaaggtaagaatggtggcaagaaaagcggcaaaaatcgattcattatataccctgtctcgacgaacgcaaggttacatggcccctgcatcggtcagtgatcggggctgagtgtctgaaaacaacccctcatttgctctgctggtcgattgacaaggccgtatcaacttgccttttttgctacgcacgcagcgcgtagcgcgtcatctcgtgtctccattctgtcatcaaagcatctctgacaaatgcgtgctctctttacgtggacaagtaaccttgtgtacacccaacgcactgcgcacgccgcaaaatgccgagaatagtcgatcgaaggggtgacttccatagccaatgattacagcactgcgctgacaaacacgaaggacggcgcgtacttgacctcacgctgcaatgttgtgtgccatagcagggtgcttggtcgaatttacaagcgcgcatacatctactctactgcgctttcatacaaggaattctactatgaccctggcaccttcctatagcccctagcaactatatcatcgccctcacctgcgcctctcggtgggcgatcagacctcaaatcttgcaaatgatcgtcgactagtgcagacatcgtcctggcgcggtgccaccggtatggttggcttcgccagagcaagggctttcgtccgagccgcttgaatcgctcgtccggccaaattcacaaatcggccagattcgccatgatcaaaggtccctcatcttggcaaacgggtcgattcggttactcatggcgtcaggatcgccaatcgccatctcgactgcctcacgcccttctccacactctgaaacctcgatccgaatgcatgaccaagatcattctccaacactctcattagccaagtcgccgtctgaagttggggtcagatggcgctagattgctatcggtgagagcgctggagtaccctagggctctcgatgcctccttgacgccctcgaaggcaacgccaggcaacgccaggcactcactgcgatccgcgaggactctttggcgcgccgcacggtgtttctgcagtatgacatttcagtgtcacagcgccaaaaccttaaacaaatggtatccagagtaccagcgcccttataccttctagcagggccggttcttgcaaatggtcgttgccggtgcaataaccattataattcgatgctgctggcacggttggcttctcccgagcgagcgctttctcacacgcgcttaatatacacattgtagaggattttatgaaaaaacctaaagccaaaggaattcaggttaccaccgcctatataccctctatcagggttggttcttgcaaatggtcgttgccggtgcaaaaaccattataattcgatgatgctggtacggttgacgtctcccgagcgagcgctttcccccacgcgcttgatattcacattatcgtatttttcatgaatttgcttcttttcgcaaccgttcatcgtctttctgcctttgagatgcagctcaattccgcaggtcagattgtcgcgatgagcaatcgctgaaaatagtgccctgcaatgttagcacgctctcaaagggtgggaaaagcggctgcaatgatcagatgccaagagtcgcattagcccaccctcgcctccgaaagcagcgcagatgggttttagtgtataggtgtattttagagtgctacgaggggctctagaacctttaatggctgcctggcgccctggacaacggcgccagcggtccacgatgactctctgtcgtgttatacaggccgcacggtggttttgcagcgaattgttgcacgggcagagcgcgtaaaccttaaaagatagaatacaggcacaagcacttttctactagtactttgctatggaccctcaccttcatatgggcccatatggaccatccacatatcccattcggcgcctctcattggccgatcagaccccgatgcttgcgcatgctcgtcgactagtgcaggaatggtccgtaggcagtgccgccggtatggttggcctcgcctgagcaagggctttcgtccgagccgcttgaatcgctcgtccggccaaattcacaaatcggccagattcgccatgatcaaaggtccctcatcttggcgaacgggtcgattcggctactcatggcgtcaagatctccaatcccaatctcgactgcctcacgctattctccacactctgaaacctcgacatcgatgcatgacccgcatcattcgccaacttttcaattagcacagtcgccgtctgaagatcgggtcagctcacgctagatcgctatcagtgagggtgctggagtactccagggctctcgatgggtacgtggtgcgctgggtagcaacgccaggcaacgccaggcactcaaagcgatccccgaggactcgctggcgcgctgcacggtgtttctgcagcgttttatttcagtgtcacagcgcgaaaaccttaaaccaaacagtgttcagggtgccagcgcctataccttcaatcgggactggttattgcaaatggtcattgccggtgcaaaaacaatgataattcgatgctgctggtagggttggcctctcccgaccgagcgcttcgtcccatgcgcttaacatacacattgtaaaagtttccgtgaatttggtccttttcgtacccgttcatcgtctttctgcctttgaaaagcagctcgattccgcaagtcagatggtcacgatgagcaatcgctgagaacagtgcctcacgatgttcagcacactctcacaggtcgggaaaagcggttacaacaatcaggcgccaagaatcactttagcccgcttcgcatccgagagctgcgtacaggtgttttgaagacggtgacagggtgcgaataggacccagttcacggaaacttttacaatatgtatattaagcgcatgggagaaagcgcttgctcgggagaagccaactgtaccagcagcatcgaattatcattgtatttgcaccggcaacgaccatttgcaaaaatcagcgctgatcaaaggcagaaagacgatgaacgggtgcgaataggacccaattcgcggaaactttgacaatgtgtgtgttaaacgcatgggacaaagcgctcgctcgggagaagccaaccctaccaacagaattgaattatcaatgtttttgcaccggaaacgaccatttgcaagaaccagcctcgatggaagatatataggcgctggtaccctggtcactacttggtttaaggtttttgcgctgtgacactgaaataaaacgctgcagaaacaccgtgcgacgcgccaaagagtcgtggcggatcgctttgagtgcctggtgttgcctggcgttgcctgtgagggcgccaggtaggcatcgcgagcccgaaagcacactagcaccctccttcatagcaagatatcgtcagctgacccaaactttaaaaggtgaccatgctaatcagcatggtggatccagctcattccgccttagtaacctccaggtttcaaagtgtggagaagggcgtgaggcggtcctttcagcgattggcgattttcactatgtgggtagcggaatcgacccgtttagcaaagggaggggcctttgcaaatggcgaatcttgccgatttgtgaatttggccggacgagcgattcaagcggctcggacgaatgcccttgctctggcgaggccaacgataccggcagctccgccagaggacgatgtttgcactagtcgacgagcattggcaagaaccgaggtccgatcggccaatgagaggcgcggatgagggtgatgctatgggtgctatgggccataggaaggtgttctgtgccgttaccctatgtacttgagcgactctagtaggatcatacgcgggagaatactgctctgtgctacatatagcacctatcacggtagatatatatgaacggccgaccaagcaagccttgcactcagatccgtatatgtcccttcctgagcactatcagagacaaaacagtatatttacatgcttagtcgcgcaatcaagcaacctttgcgtccataatggtcaaggtgttatctcctctctctctcactctccctctctctctcactctctctcgctctctcgctctctctctactggagggttaaccggagatagcgatattccctcttgatgttttgaagctccatgatgttatccgtgttgcatatggccttggaaattgcgcgaccactgacgcgcattgataacgcgggacatgaattttttttttggtctctcgttttttttttgctgcgaggtccatggaagaatccgcgagggcgcgaaaacaaaaaaaaacgtggcttccactccaccccgccatagaagtccgggtgagaaagggaagggccagccagccagccccacccaggaagtggtagaaaaatcccggtttgttcctatgtcggcactgggattggtggtcggcgactgaaaaagacgtgagcgaaatggacggttcgcaatcttcaagtgaaggctgaacgtctggcattcaataagagattttttttgttctgtgtgtgtttgagtagtaattataggaaaagtgctgcttatctggccgccagagaacgttgtgtcgtggtcaggctctggctgtgttgaaatgtatatacgaaaaagtttgatagtgggtcgtcgtcattgcgcctgtgtatgtgtgtgtgcagtcagggcaaaagttgtgctgaggtccaaaacgagcaaggaaaataagcattttcaagcacagccagccaatctcaggcctgtggccaggcaccgacacgccttggccacattcatatcgctgcgggcttatctcttgcttcacacaaatgacaacttttctagaaaaaattgacagcagcaaaccgatagcgtgtgcacagcagcagcaggggaagattagaaaaaaagaaaagatataaatactcggcacattccatccatgttcacatcctttttcttctctctctctctacttcactcacaaacaaaaccgcaccttgcagctctcttccaaacgcaaagacaaaaaaattaccccctaccacaaccaagcacacccaccacccgacactcctcaacaccctctaaccaactatgcaatccatcaacaagcgcgcctccaagatccaccccactgcctcctcaacccctgctggctcccgccgcacctccatgcacgaaggcttctctcgccctgccaagaccgagcagcagatccgtgaggaactcatgcacatcgacatgtccaagtgcatcctcgtccacccatcgcagcccttcgtcttgtagggggtcaggtctttggcatgtcttttttttccgtcagatcgtatcgattcgtcccgagctgttaaccattgtcagcaagcaacgaccaaaaaacaacaaaaatacaacagacaccaccctcttctttctgcacctttcaacagttgtgcgaaaacccgctctccctcagtcgttcccccccgctcgccgccaagcgccgcagatttctattcttgccgcctccaggcccccgagggacgcaaggatcctcaaccgatccagccgccctctctccccaacctctatcttgtttggatccgacctgcctatcaagtccatcctaccaactagattgagtgactctcctcaatgatggtagtcttaataaatgaaaatactccatcctacatactcatcgtcatcaagcgtgcttttttttttccatgtttattggcgcgttaaactatctgtgaatggaactgtccagctttggcgtctaaaagttgcctacggtagtggtggtgggggaactgcgaaaaaagtctagggtatacaagtgttttttttttgaaacgaatgacttactagaaagattatatatatacaaggatgaaaaaacaaaaaaaaaaaacaatttacacgatcaagggctggaactcatagcgcgatttcggcacgagcatgaacgcaatatgttcacaaggatctatcatctcggcgccttcctccatcctcattgccttggtccccgtcgccgtcatcttcagcacctcatcgtcgtcgttctcgtcgtcatcgtcatcctctacctgcaccgggatatgctcctgagcctccactgccaacggcgagagccgatgagccgtcgaggccgtcgtcgtcggtgctccgggtcgcgataccgtcaccgtcgtcgtcgtcgtcgtcgtcgtcgtcatggctgctggtgttgctgttgccgcggtcttcgcatggctgtcgccgctgccactggcggcagaaacaatggctcctcgacgcgtgcccttacgaccgagtgccaagatcgccaaaatctccctcctcatcgactcgtgctcgtccatgtccgacatggtctccaagagcgaagacaaggacgtggacgtggacgccgatgacctcaacggatacgacgtcagatccgtcccctgaccgttcagacccgtgtgcttcttgacgtcgtccgaggcacggctgcggtcgttgctttcggtcttctcccctcgaggatcgacaaaggtcgaaaagtccagtccacggccgttcgcaaacctcagcgaccgtctcatgctccgggtcggcaccgtctctgcgccattcatcgttatcgagtgttcgccttctcccatccccatcgaaccgggtgatagtggcgtacgctggtgaggaggatgatggtggtggtgagtccgggatcggaacagggacacggtcctgtggacaggcaccttctcggacaagacgcttctgatcagggcttcccgctcctccctctgcttctggatctccatcgtctcgggtccagcctggagcggcttgaaatcatacatatggtcactgaccgtactcgccggtgcagagcccgtcgatcggcgtctgagggctcggtctgcggcggaatcacgggcactcgatccgaccacggaattggggcgactgctgtggctgtggctgctacaaccgctactgaaccgggacgaacagcgccgggcgagagaccgtaggggcggcgcaaggtggtccttgagtgactttctgggtgcgtgagatgaagaagacgtcgacgatgtcgacacgttgggaggatggctgttgccggggaccgccgccacggccggggcgctctcgtcgtccgcctcaggggtgacaatgacaataatgtcttcggcgtggaccgtcgagtgcgcgggggtcgctgagcggctgctgggatccttcttagccgagaggctgatgcgtttgacggccgctgacagcgtgttggatcgacagagacccagaatgcgcgatgtctctgcagacagctgagagggggaggccaatcggttgagcgaacccgtccgagccacagaactgtcctggcgctggacctgtcgcaccgcccgggcttggttcggctgacggagctgttgacgagactggcgctgtagttgctctcggcgcatcttcttggccagctgctcttcctcttgttgcagacgttggtagtaattgtgccgttcccatgcgagctcattggctgtccgggtggccgtccagcgttcaaaagactcgacaggctcctgcacagacgtggttctgtagtgttgctgtgctttggaagcatgatgtgggaccacaggatgggcaggatagtatccgtggtgctgtggggaggcgtggcgagcgcggtcggtcgagtggtgtcgctggtgcatctgtcctgggtggaagtagtgttggggctgctgtggccatggcgctggtgcgtggttggggtggaccaatgagactgagcgacggtgggcagatccgcgaccgcgaacgacggtgctggggcaggccgagtgtggaggtagaggtggaggagggtagagttgagtgtgcgctgagggcatagggcgcccacgcgtgggtacgggatgctgagaagaatcgacgaggttgtgctgaagatgggtcatgtcctccatgctgttgctatcgtctcggggctcttcctccatgggttcaagtgcgctgtctgtgcagccttcttgctggctcagccaagccgagacatactcctccctggtctgcttcagtagacgagggtcccgccgatggccagtggtgctgggcatggtgacagagtggtgctgtggcgaggacgagggactgggtgctgagtgtgcggcggtgctgaggagttcgtcgtggtagtgagaagacagggggtagtctgattcactgtctttataagcgctcgatcgctgcggtgaggatggcgacggtggggcagaggagtttgaagggtcaattaggttccgacgccgagaaaggggtttttgctgcgagggtcgacttcgcctccgcaggtgttttcgcctgctttgcatcaaactcagaaagatgaccgtcagagagatggagaggagcgtggcgatggagaatgtgcgcgagtgagaggagagaggggcaggtcgaatggggtggatcagcgttgccttggggcgtcgactggctctggacaacgaggttggcctgctgttgcctctgctgctcctgttgctgctgctgctgctgattttgctggtggtttggctggagtggactgcggagcaaggtgggttgagagaggacaagagaaaggtagaggaaagagagagggatgcggatgagtccaaggaggagggagaagcagtgcacgagtgcgcaaggaccgctgacgatggatctaccgaaagtagatggtgctcttcggaagtgtccaacgtgggtgcggcggagagagcaatcgctgcatgatgatgtgggccgatagtgctgagtgcgaatgtggcactggcgcatgtgctgaccacagcgctcttcccgtccatgggcgggagtgatgacatgcatcgatcgcatggggcatcagcaacagctgcggcagaagggcagtgttgcgctgtcgaggctgacagggaggtttctgtcgagatggcgctaatggcctgacatgaaggtgcaagggtcgatgaatatgacgaagatggcggtgatgatgacgaagtcgatagcgtgagggtcccagagcacagcgacgaattcgccgtggaggacgtcttggtggagcaggcggatgcggtcgagacattcctgatgactgcccggagctggttgggagtgggttcgttaggcaagagggtgcacagacgtagccgagagcagccgtgtgcgacacaagatcaattgagggtagggtttgcggatgataggagcatgagcgcatgagagcgcaggggacacaaacgacaacaccgtgggcaattgtcgatccgagaggggggaatgacgcgggcgaatcgtgcggtggtgcgatgccgaggagcgttgcatgaacccagtcagtaatagaaaagagagcggggtgggggcacgatagaatgtgcggtggaacgcagcaaaggacgaggaacagaggggagagaataatatgcgaggcagcgttagtgtccatctttgtgcttctcgtatgcatctggtgcgtccatatggactggtccattggagctagactggtgcacgacttgctttcgtaaacagcacatcattcgcgcctggcgcgatagaaacaaaacaaccgccagcaaaaaaaaacgtaaacaggccaaatcaacaaccaggctttagaaaaaaaagaaaaaaaagatggtgcgaccgacggttgtaccttgagggttgcatctgcatgatgccgcgcctggaaacgctcttgcgcactgaggacaagctcgtgaacaacctgccttgggtgcttcgaccgagccaaacgggatgaatcagacagagccaatgtaaagaagaggctgtagcgggtaacgatcgggcagaggacgttggacatgatggatgctgggtatgtgcgtgttttttgtcgctctcccacccctcgttatttggtgctggtaaaaagaaaaaaaaagctgagttggcgtgtatttggactaggctagtcgattgattctgaagatgctgctgatattgttgctgttgttgttgttgttgttgttgtcgttatgcttcttcaacgcctagccaggataagatggctgctgaggaggggattcaaggagacgactgggaaataccaggagtggcggaaaaaaggagaaaagggaggactcgaccgcataagcttttgtcaacgttccagctaaaagcaggcgcgtttccttgtgagcaaaagaaaaaacgaaatcggggtggcaggaatgtagatcgaaacgatctcgatggtgttggtcggacaagcgagagagccgggcgctgtgggtgtgtacgttgcaagggagtgttacccgagatacgaagcgtcgtgacagaggaggggatgaggttgggaaggaaggaaggaaggaaggatgatgattctgtgatgcaaaagaataggagataaagggatcacagctgctgtgtgtggttgccacaggtgtaacgtatcgaatgagtacaaggaaaaacgattaaaacaacgagcgcaaaggaaacaaagcggagaagagatgtcgataaaaggacgagatgggggagagggggaacagggaaacagggggaggggagccagcgcgctctttttatagtgccgcggaaacttgggtggtcgatcaatcaatacataagaaaaaaagaaaaaaaaaaagaaggcagcgggtaatgagggcgtgggatcagggaagagcacttggcgaacgagggagcgagcgagggagcgagcgagcgagcgaagcaaagggtgtgagaggatgatgagcgaggcacggggcagtcaagagggagcagatatgaaaaggtagtgcacgcaatagcccgcaatcatgtcttggctcgagtgtgcttgggcttatgagctccagcccactactgccactgacagcggaacggatgggaggatagcacaggcggatcgcggagggggacagagagaaagagacgcgggctgggaagggccgaagggacgaatgaggaacgtgaactgctgaggaggcgcaatcaagtggagaacgagagagaagagcgtcaacgacgagagcgagtgaggagagagagagagagcgcgagacagaggcagaggcagaggcagcggcagaaggaaatggcgagcttgcttggagaagattttgaaactgtaatcagcgcaagcaagtctagatccaggacgcatgtcggaggcgcgtcgctggttacagccgcttgtctgtccgacctctccagaccactgctgtagatgggatgatgtggttcaatagcgcgcagacgtgtatgcaaggtcgtattcttgcgcgtgcaaaaatacaaggtgcaaagtaaaactgtcagggcctgccgtgcactgacactttttaagcatgagaaagaagacaagagaacaaaaaaggtgcagttttgtttgttcgttccgtcagcgggcctgttcgcttgtccgccaaaagggcgaatggcaacggtcttatctctgggagtgaggcagggctggggtgtagggcccagcggaaaggctgctgctgggaattctggagaaaacgccgcggatctttcgagaaaaaggagtggcaacaaggtccagccatcgctggcccatccaaaccgaccctagacagcggatccgggctaatgtgaccgcaggagagctgtgcaggcgagctctgacagagccgttgagtatgcaatgaccacgtcctctcgtggcaatcccagccagagagattttttttttagcaatgtgcttggaaagcacggcagtccggcttctttaacggtgtcccagctactctaagcaggacagcagccgtaggttgcggcctttatgcagtatcttttgaagatttggtgttgagaacaccacagttttcaacccctggatcctggcttgctgtgccactcctcataaagttccgaggagacgagtggaaggggcgcagggaaggaggaggagcgggtcgaagggttgatagagacaaaagatttttttttttgcattggcatgaatggaaggggattttcgtgtgcctgacagggcgacggagagttttcgggtagcccgtctctttgcacagtagattcagtacatgttcatgtatgtacggcactgtgcaagattacgtgcaccaccccctggcataggagaacagatagagcttttggggcaaaggcgaggaccaatcgtgttgtactctaagctgcctccgatctgtcgccatttcctctgcggacgcgtatgcatgatgcttgttgggggatacgcctttatatacattgacttatgggtggggtgatgatgatgaaagacagacgaggaaagcaagcagggccatggcccgtgggttcagagcactggcatcctgctcttagtgacaccagaccttgggcctcacatcgaacgcgcattccttgtccctgaaggctgggaagatgacgagagcgaccttgccctcaggattgctcttgagcgacgttcccatggtatcctcatcaaagggcgtgcccaagggaatggtcacaggcgagatgacggactcgagtccggtcatggctattgcgagctcgaacgccttgttgcagagatcccggaccttggccagctcattcgtattggcgtacacgcttgagaggagctctgagagcgcagtggcggtggtgttgacgtgctcctcctggcgcacctttgtgtccgggtcctgggtcaccatcacacagagctgctgccggaagcgcaccgccatcttttcgttcctcgagaacatccagtcgtagatctccttgaagcccttgttgtagtcaaagacgcagcagagggccttgtcgaaaaagtgtgagacgagggtggacatgacgaccgactccataaagagattcaggtggaacgactccagtttgtcctcgggcacggggaagccctcgaggagacccttggactttaggtgctcgatcgcgacgtccttttgcagattgaccgagcgccctccctgagccttgcggatcagatgctcgatagacgccttgagctgcgtcaagcggtccatgatggtcgagtgatcgtcgtctgtgggtcggatcaagcgaacgtgctccagatagttctttgacatgacctcgtagtcgctctcgcgcttggccagcttttgctggatgtccatgaagtgtctgttgaggtcgtgataggcgccacgcgtgcggttcagctcatcatccacgctctgcttctcgttcagggtgtcctcgaggtgcgtctggagctgggcgttgagcatcaggagctcctcaatctgcttgcgctggagcccgcgttcatccacgtccgcgggttgagcaccctgctcctttgtgactgaacccgcggtggaagcaggcgcgactgcagcgtcgttggctttgactaggtttgaggttgaatcacacgacgtcagtgtcaacttggctcatttccctggtcacgactggtcattcctaaacattcctagacactcctgaacactcctgatcattcctggtcatccctggtcatccctgatcattcctggtcattcctggtcatttccctagtcatccttagtcatccactagtcatctctcatgtccttgtgtccacgggtcctattttttctttctagctcaagctgcattccgtgtttttcagttgagtgctcacctgcaacatccgtgattgcgctgtcagagtctccgtcgtccatgatgatatcctcggaggtcgagatgctcagggccacggttggctggacgggggtgaggacgggagcagtagggctgacgggtgtgagcgcaggggtcacgctgacgacagcaggagctggcgcaggcgcagtattgacggcagcggcagtaggggtcgcaggagcggcggcagtagcggcaggcgtggtggtggtggcaacagtagcggctgcgggcaagctggctgaggccaacgactctttgggttcgatgggcgactctgtcacctggggtgcggaagcggatggggcagcagcattggcgtcagcagctgtggcggcggcgggggtgtcgggcgcagggttgatgtcgagcatggcggtctcgctggtgggggatggcaggagcgacggtcgtttcttgtcctcgaagctgggctcgctgtagaaggcctcgtttgcagagtgcttgaagctgacgttgagattgaggttgagcggcgaggtgggggcggaggacgaggaggaggacgaggaggaggatgacagcggcttttgggttgacatcaaagcgacagcagtgcagggatccgaaagggatggaaggagggatggaaggagggatggaaggagagatggaaggagggatggaaggtcgactgaagaaggactgaagattgacaaaacgaagaaggcagatgagaagaaaaggagaaaagaaaaaaagcgtccgtctcaactgctgttacgatgatatgagatgaggtggatatgccccccttgactgtcgagctgcttttgcttttctgttctttttctcaacacacacacgctcccacactcacacacaacacatgcacacacaacaggtacacacagacaaacactgacagacacagagagacacagacatggcagccgtcgccatcgccctctcgaccatgcctgggacatcctgcctcttcagctggctggctggcgcctggctgttgtgtccgtgtctacgtctgtatggctgtgtctgctgctgtatatctgggtctgctctgctgatggcggtgttggggttggagctgtttgcagggcgagaaagtcgctgcagaccaacgcataagcgtgcctgcctggtcatttccagctgcatggtgcctggatgggatcctccatagcctcctccaacccgcgctgtgaacagactacacacgacagcctagctgcaagtaaagtgcagatgcctatacatggactggtgtactgtgtacatagattacatgtacaccagccaacgcggcgtggaatgctgatgcggcggggcatgggcacacctcttgcgagcactctgtctgtggcgtgtgtgtttgtgtgtgagccacagcagaacatcagtgagccgcaggcggaagaaaaaaaagaaaaaaaaaaaaaacgcttcagcctctctcgctctcgctcagctcggtgtgctctctgccttgttcgcttcccgtctcgctgctcgtcaggcgcgtgttcccatcacccgccggacaacaacagaataaaaagaaaggggattattggaacaggaaagcgtctcgggatggggagatggggtgcacagcccactcaaactctgttctgactctgccacacgccatggatttcgatgcgatacctcacactcacactcacactcacactcacactgacactcacacacactcgcacgcctgtccctttgttcgcgagagtcgacggagaggggtcaggcgggttgctgcctcgggcactggagtggccttgccaggacggtggagaacgatccagagtgtcgcccgggatggccatcccatcgacccaaaagggcgtgccagagcgagcgagagtgacaaggagagagacaaagagagagagagagagtgcgcagacacaggactgcacaagggtgggatggatggatgtcattcttcagcgccttttttttgtctctgtctgtctgttgtctgtctgttgtctgtctgttgtctgtctgtctgtctgttgtctgtctgtctgtctgtctgtctgtctgtctgtctcttcttttccctcttctgtctttcgtttgattcctcttgtcctcttgtccttttgtccttttgtccttctgcttctgcaaccccctcgtcctttcttttccttcgcactcgtgctcgccattcccatcgccatccccatccccactcgctgctcgctgctcgctgctccatcccacctgcaccatcgccagctgtttgtcctggtctgtagcacagccatccctcttgctcgcgctcactcgccttcgccttttcctcggtcctcgcacctctcccccttgcaccttccctcggttcaactcccctcactccccctccaacgactgctggtctcgactctggcgcgatgcagcagcaggccttcaacccaaaggactaccccatcgtcatggccattgactttggaaccacattctcgtacgtgtagcaccccatgcactccacagtcgtcttcgccatgggccactctctttcccctttccctttccctctctctctctttctctcgctttctcgttcccgttttctcaccttctctttcgttgacactttaacgacgcactctcatagaggatgtgcctatgcctatgcacaggacgacaaggaggtcatcgatatcacctcatggtacagaaccgttcaaggcacagctatgcacgctatatccaatgcacactaccccccctctacttccatgctcactctctctgcacttgcatacccccatgaacaatgcacaacaataggccgaggcagagcatccaatatccaaagacccctaccctgaacctgtacaaaaaggatgaccccgaacacaagctggtcgcctggggctggaaggcaaagctggagaccctcaagcctacggccagacaccacactctcttataccagtacaagctgcatctggacgaacacatgcaaaactcgccgctcgaggtcgacatcaccgtcctcgacgccatctcgcactatctcgacgcgttccacgagtacgtcgtcggcgagatcatgcgcgggttcgctcgaaactttcagcgcgaccatttccgctactgtctgacggtgcccgccatgtggtcggaccgggccaagaacgtgatgcgacaggccgccgtcaaggccaagctcatcaaggaaaccgaccatcctgaccgtctcatgctgatctcggaacccgaggccgctgcgctgtactgcgagcgtaagtgcgaccagttcgacctcggccacggagaccgcttcatgatctgcgacgccggcggtggcactgtcgatctgatcgtctttgagatcgctgtcaccagcgctggacggcgtctgtccgaggtcaccaagggccacggagcctcgtgtggctctgtgtttctggatcgccacatgcgtcgactgctggagcaaaagtttggccatcacgccgccaacttcccggccagtatcatccccaacctggtcgatacctttgcggacgtgatcaagccccagtttgacggcatcgaggaccagttcctgcagctgcctgccaataggtgctttgaggacctggaggacccagaggcgattggcatcgacgacggttacctggtcttgaccgcggctgaactcaaagagaatgtgtttgagcctgtggtgaaggatgtgctctcgttgatccaggagcagctgacacaggccaagaactgctcggccatctttttagtgggcggtttcggctcctccaactacctctacagccgtgtcaaggcccagttcagcagccaggtaggactcatctccatcccgcctcgccctgagctggcagtggtccgtggtgcagtttgtgtggggttgaacccacgggtcgtgacctcgcgcattgcgcgtcggtgctatggcatctcctcggatcagccctttgagaagggcaaagacccgctggcgaagcgcaagtttgaggtgaacggcgtctggtgcatcgaccggttctcgccctatgtcaagcggggccagaagctcaatgtggacgagtcgatctcgcgcgagttctcattcacaaagtattcggaggcacctgaggactacaacattgcgctgtatgcggcggacacggatggcgacccacctcggtacacgacggatgtgggcgtttccaagctggcagacatcccgatcccgtgtcctcacgcgccctcgtcgcgtctgggctctatggtaagctgtctgaagctgtctgtggcgatacaacgataggtcgttgccatgcgtgagtgcagtgtgctgacaaaagtttttttttttcaactgtataggtcaaggtgaaggtgaacatgaactttggactgaacgagatcaaggctgaggcggttgttggcgacaaggtgtacagcaccatcctgcagtttgatgctgtcgacacgttctaagcttatatgaatacatcattagtggtttttttttattcaacagtaatgctttttcgtgattgtgggctgcataagaggagcgtgccgagttgtgggtgtgcacaaggggagtggttgtctcccacagccctcgctccccttttggtgaaccttgttcatcccattggcatccctccgacagcccatctcatcctgctcgacgggcgtccttttctctgcaagcacgagcagccagcacgacgcatcagcaacagcacgacgcatcagcaacagcagcaacagcagcagcagcagcagcagcagctcattctgtagcctcctcaggtacacacctcccacattcagtcgcttgcacgctcattctttctttcttgttcaacctcctctaaccaccaacccccatttccctcatgctgccacgtttttttgcaggcatccctactactagacagtgccagcgatgagcagcttctttggtgctcccggcacaggctcgggcaccggcgccaagggctcgccgtccaacagcagcgcgaccacaggaagtggcggcggcggtggtgggtggggcagcttcctcaaacaggggctgtcgacgatcgaatccaagctcgacatggtccttgacatgcaggtgcccattcccggaggctcctcgggcaccctcacctcactctcaccccacgccaccgtcctgccctcgagtctctctggatccaacagcccaagcaacacacagcctaagaggatagcctcgccacaggtgcctggggcgggtcgtaccgctgcccttgctacggctgctgacgctgacgctgccgccaccgccagagcttcgacggactcgcgtggcgaagagagtgacaagcgaacctttaatccagtcactcgatccagcctcgttcgggacaaggacggtgctgctgaagagacggggatggcggatcaaacacgcaagggaatgatcagggacgacgttgactcggtcacggtggatcctctcacgggcatgatcacgaccggccccggcatcaaacgcatgtcgacaccgcctacatctgcggcgagctcggccgcagctgcggcggcggcggcgaatcgggagcgactggaacagcggatgaggggcatttttaaaaaaccagcagcagcagcagcagcagcggcagagtccgccacgtcgacaacgtccacgtccacgtccacgtccacgtcgccgtctccttccgtcgctgcctcgccttcttcacccacaagaccatctgcggctctggagcgagaggataaacctcaggatccatcaacatccaacgcaaagggagaaaaggagaagaaagagactgcggtggagaaggaggatctgaccgaggacaagggagaggaagaggacaaggacaaagtggaggagaaggataaagtcttggacaaagaggctcttgcagccgactcttcgaacgacattcaggaggaaaaggtggaggaacaggaggaacagaaggagccggcaaaagccgagcctgtatctcaacaatcaaggtctgatgtcacagaggaaggggctatcatccaaccgacatcttccgacgatcaggaacacaatgttgtagtcagcgccgaggaccgttccccagaaccggagacagctgcaccctcggatcagaccaccaagtccaaggacgacggccatgagcagttggatatgtcagctcagaccatcaaggaggatgatggagcggttatatcaaagtcaaactctggagaccaggacgatccttccaaagtcgaggatgagccaacagcaccagtagcaccagaccaggatgacaggactaaggcttcggagaagaaacctgacactgccgaacccaccactaccaccaccaccaccaccacagaaaaagttgattctgcaaagtctttgaaatctgatgacatccaaagcaaaagctctccgacaacaccgtccacagatcactcttatacccggaccagcgctgaggaaaccaccaccaaagatccagcggtcgccgccgccgccgagatcgctggagccgctctgaaagttgagaacaagtcgataagcactggatcaggcgtcagtcacgaggcttcgactcttgacgataacccactcaagagggtcgttgagcaacgtgaggagcaactgtttaaggtcatgcaggaacaatcatcgttactggagcgacttcgtgatttggaagatgccaaggcagcggaggatgctctccaggtcgtcaagattgcaggactcgaaaagattattgagacacaaaagaaagagctcgaggtcgcgcggggaggaaaccttgccagtcaaccgaaatcgatccaaaagaccctcgaggagcaacggggattgctggaggagaaggatgagcagatccgaggactgttagccgagggtaaggaaggaggaggaggagaaaaaaacaagtgcgccatgcagcaaagagacaagaggttcaaatggcaagccatctaacataaccccccgtttgatttcgtttgctcttaggtgagattttgtccaaaaaggagttcaagcacttgacgacgatcaagaccttgaggatgaagaatattgaggcggagaaaattcagatggacactcaaaagaagctggataaggccactacggcccatgcagatgcgcaggcgatggtggccaagctcactgaggagaacaagcagctcaacggtgagattcacgttcatgatcatgtcgcgcaaatgaaaatccttgtgttctcgaagggactatttgcttggggcatttttcgaaaaaaaaggccatgttactgtgggggttatggacatcgcaacggccaagctgaccattttgctttttttgtgggttttatcattttctcctcctagatacgatcaggtcgctacacgacaccacgcagcggcaaaacaagcagcaggttcagatggagtctgagctcgctcaactccgggaagaaaaattcagtctcaaaatgggtctggatcgcgcgtggcaggaactcgcggacgctcggaaggcctcggctgaactgtctagtcagacccaggccgctgcattggagcaagagatgaggatgaacgaggagttgcaggctgagctcgacactttcaaggcacagcatgccgcgatcgagtcgtcccttcggcaggagatccaggaacttcgggtgtctctttcgaaccgcgaggaggatgcaggacggaaagaagatgagctctggatggagatcaggagccttcagcagcgtctggaacagaacgagaacgattcgtatgagctgcaggaggctctggatgaggcacgcaggccgcttctgcgacagatcgaggtgttgcagaaccagcatagtacagccaaccggaattgggacaagatcgagaagagctttacgcggcgtgttacggaggcagaggaggacgttgccaaggcgcaggatcgcgagagggccgctcgggataagctggatgagatggtaagcgatggctgtttttgagactgaaaaaaaaacaatctcttgaatggctgggatcactcatgcggcgttcgttcttcttgatgcttaccgccttttatcccttcctcctccctccctcccggatgactatgaatccatgacagaaatctcaaaagttggccctggaggcccgcttggagaccctcaggaaagcagacacgcaacttcgatcggatgtgggcgccagcaagcgctctttagccgagaaggaagaggaggcgcgcaaagcacaggcagagctcagcaaggaacgcatcagtcgcgagcgcgccattgaggaggctagagaggacgcagaacgcaggtgtcgacagcagcagctcgcggaggttgagaaactgaagcagcaaatccagcaactccagcagcggccagcggatgattctctggtggccaacccgacggatgctcttttgtcagtgggtgttggcatggccgccgcacgacgattatcgtcgtcctcgggaacgtccgtatcatcgcccatgttggcaggcggaccgattactgtgggatcggccaaggcaggagcagccatgaataataacagcaatgtgaggacgagctttgactcgatgacgagtcccacgagtctggacggtatggcaccgacactgtctcgtagcagctcctcgcatacgatggcgggcaacagtggtgcagcatcgtctttggggctgatgggccttggcggcggctccacaggtcctgctgtggccatggagcgactcaatgccatggtgcggcaactggatggccaggtcaccttcttgactgagcaggtgcggtctgcaaacaggaacaaaggtactacagaaaaaaaaagggagagcgctgctttcttgccaagaaaatttccatgtaacatcgtgggaatgtgggagcgagggtttttctttgttgttgttgttttgtactgacgattgtgtgtttttttatgctctgtattacgcctctttttttttgtatctagatgagctttcagatgagttggtgcgtgtgacggtagagctggaggatctgcaaaaggccgcttctcgggtaccgggtctggaacaggagctgggtctgttgagggaacggcatcgggctgcattagagatgctcggtgagaggacggaggaggttcaggaactgaaggcggacctgtcggatgtcaaggaggcctatcgggatcaaatcaatgacctgcttgctcaactggagcgactgaggaggacgaatgcacaataatacttttatttttttaatcaaggagaaaacaacgcgcggcagcatgttgtgtcttttttactcggatagcaaagccgtgacagctcccctttttacttcttattcgtttgcatcgtttcaagagcgagtgaaggggtacatgtccgcaaagggatcgtcgtcggcgtttctgtgccaggtatactcgatcgtggccgacaccctctcggccgcttccttgctcgccagttccgacacggcgtacaacgccgcatccatgcctaaagtgaaagtagaagaaaaaaagaaatgaaaagcaaaggcgagaactatcggttagggctaaaaaaaaaaagaggtagaagtgggatttcgcgctatgattgcccacttgacccccaatcacgcgcccgtgtttttttttttgcttcctcatcttacctgcggacactcccgaggaggtcacgtatttgccgtcctggacccaacgcgccctcttgatccaattgaccttggggcctacgaccgtgcaatgaaataacgaaaaaaaaaatacatagtaagtcgcttgtacaaatgatcacagcgcgtcaagaatttgagaaaaatcgcggtctactaaagggctcagaataaaaaccccccgcccgtccttacccagggggatgatttgttcaaagtacgccttgttagtgctattcaattgagtattttgtgtttttaaggtaagcatcatgggcttcctgtacttctacttgggtgagagatagaaaacgcaaaccaagaaaagaaaaaagtttgccttgacttacgtgacgttgtatccatccacaagacctgtggaggccaagatgccagccccgttgcagacggtgaagcaccacgtcgcctcttgaatcaaggtcttgacgcgactgagcacctcagggttgtccgtgatggcctctgatccgaatcctaaacagaaccatcccaaacattcggttaaaaaaaacaaaaaaacaaaaacgcgacaggttccaccgatcaacgagaggagagggagagagagagagagagggggggggggggtttcgaacctccagggatgaagatgatgtccatcttgggcgcgtccgcaatggtgtagtcgggcgtgaccttgacctgttgggaggtcgccaacttctcgagcgtgcaggcgagaaagttgatctggatgtcaaggtcgttgccttggtcgccataaatgcgcataggccccatcagcttcaaaagagaaatacaaaagataggtctgatgtcaaaaaggcgagaccaaaatcattgttttaaaaaaaaacaggtcgcgcaaagacagttggaaggaaacgacttacatcgaggagatccatgccgggatagacaatggcaccgagttgtagcttgccggctccctgagggaccttggggagaggaccatgggaggcaatgctggagaccattctgtgaaaaggcagggggttgagtttgatttttgtgtgtgtgtgagagagagtgagtgagggaaaggctatgagcacaaaaaagtcttttgagttgtgatgttgagaaaagaaaaggcgatcgatccaacaggcctcgtttttatacatctgctgaacagaatcaaaacagttgcgagacgaccaaagttgaagaaaattgaatacacggctcctgccgttgatcgcgcggtttactttgacagatgcaacctgtcggcgtaaaactactgccttgttcaccccctccctcccctcccattcatgcaaaagcgccatgaactcgtcaatctaagaaggctgtcagagatgacatctgcgcagtgcacagttgttggatcccgggccgaacgaaataagatgcctcttgctccttcttcctgttccctattgattggggaaggaggaagggggggggtccttgtttcaaacccgagtaccttgcaagtttgtcattctgtaatttgacagctcacccgattacgcccatcgtctggactgatggctacactttgacagattacgaaatgaccttccgacaaccactcacgagcgagcgctgtccagactacctacttggcccaagggcgctgaaattccctcaccacacacacacacagacgcacacggactctactaccacagtccaatggtatttgaaacaacttaaagtgtcaagaccttcccccctccccaaaatctcttccatcaattggcatgcatgcatgaaggagcggcaaattacatatcccgaacaaatgtttaggccctcgcgacctcttgcgccccattcttcagtcatactaggaaaagaacgcgtacattcgcgagatatatatgttctagttatcgatgcagtctacgaactaggtcaaggaggggttgaccaagcgaaggacgacagagctactcgctacattcctaaagtagccatggtacatgtttaaaagcgttggtgccgaattgtgtttgaaagaccagcccgaaggcgcgtcagtttttaatagtgcgttgaatattttgctagtgtacagtgtgaggtgtgtgtgcgtgtgtgcgagagagtatgctgggaggtcaggagaaggtatcatgtggccataagggggggctgtgcagcaacccacgtatggctgctgggcggggatgctttagcggatgaaaggacccgtggcagcgttggtcatggtgttcttgaggatcatgtgcatggcctcgtcctgggtcatcctaggctggctggtgcgctgttcttgcatggagttgcgaggagtctgagctggggtggtcgcagcagaggcggtcttgttcttcttggacgaggacttgaagaaaggcatggctgtaaggagacgttttggatttggttttggttctgaagagagaggttggcttggagagtgcgctaggctcgaagatagagattgaatgatggggagtaggaaaaaaaaagagagcagggaccagggagtatttataccttgcgtaccttgcggtcggcgcgtacactgttcatcagcctccccagggcagagggaagcacaccctgcttggcatcagtgccctggccgcagatgcgtaccatttttgggcgaaattccatgtccgccaagacgattttctcgctgctgccaaggcagagcaaaacaaaaaccataatgaatttctgagaactgcggatcgggttattcgcctgcggttttcgtatgtttttttcgctccattcttattattagctccacaggccccaaatgcctgcggcgccacccccgcgtcattgttctcgaacgctcaagagaaaaaatagaaaacgtgttgcagaggtgattttatgactatatgctagaagggtatgtacaatggtgatactgggctaggacgccggtgtgtgccagcaggcgaatagcccagggcaatcaagttggacttggggccgagcttctacaggatgtagggcccgttgcgaccgccggacagggccttggagatgaggctataaagtgcttcggcgtcttgtgcctccttctgctgcttggcggtcatgttggtacttgtgcttggccgagatccatccaaagaagcacgaggcgtgtggaagggcgtgacagtggcagaagcggtcttgttcctgctggactttctgaagaagtgcatattgaaaaaaaaaaggtagcgcgtgcctggcaggtcaggttttgtaaagcgggtaggtatatagtgggtgcgtgataagccgactgctaccatagacacctgaaggtatttatatgcgactctgcctttccttttcagagactggggtcccgcttcatcagctctgtggtgcttgatggacctgagattggtagagtggctcctggatgatagtccgctagcacattcgtcaaaactcagcgcaagagacacctgcgactcttctgtctatccagtcgcgcgcgcctcaagtgcataaatagaagccgaccgtggaaaaaaaagggggaggtgagggagggaggggacttgaaagattcaactcagaccaaccgcccatctctccctgggtgaagcatccgtagcaatgagcaaaactgagtatgaagaggtttgaaatgtgaagacctcaccaacctcatctgaaaactacattgaccgttggcggtgagccaagcatagtctctccgtctccctgtgtcaggtcctgccaatagtcctgacacttgcatgcggtgcactttcacagcacatcttctgccgctcgtcgtttgggccgtatgtagtagcgagatgtacaaaagtacgaataacgcaaggcgcaggtggccagtggttgtctatattggatcccacggccttgtcctgggaaagatcatgtcgaaggcacgttcattcaccgcctcatcgaggcaggcagttcctgcatttttcacactccccgcagcaagggacatcaagaaagtgtgaaatctccgactgaaaataaaatatcccctcagctccagtctcgtctcgcctcgtagtctatgagcgaatgcgtgtgcggcctcccttcaacgtttcgcttgaaagcactcaattacggcaatgattcctaaaagagggtctgatcgcaagccaacggaaggctcaagcgcttgccttgctaactgaaaaatatagattcagccgctgtctaaaaacgtgccatccgcgacctgggtcattgcacgggcagagcgatccttctagaattcccattgtctgatgagtgaggaccttcaatattgccaaaagattgattcgagtaatgctctaggaggtgtgcactcgtgtgcggtatgactttggtgattagcggtccttgatgcgcgatccaaagcaaggtacgcctgcttaggctaccagcaacctgaaaccatctgcggcatgaggtcgctcgcgttgttgccatatcatcctacttgctgctcgcagcgttggtctctgtagagattgtagcggggctgtcaagatctaggagaaactattgaaaatgacccgagcagagaacgggcaccgtaaatgacacagacttgaggaccccactatcccacgattctccattgagagaagatgggtgaataggctggggacgggggggactattttgggggacaggacgtttgggacagatcccaagcgctgacgacaacgaaggcccaaacagccaaatccaagccccgcacggttgttcaggctgagcctcaaaaagatgtttttcatatttgtctcttgttggctccaggtgtcgagcgtcaattcgcccgctttatgaaacgtgccttgacggcaaacgttccttgtcagtgcataaatacgctgagaggcgcccgtccctcagtcgccatctttttttttctgattctccagcaaacacacttgcactctccaaaaagtctactactcctcttccagagctaccacttacacaatgactttcttcaagatcaccaagaagaacaagaccgcgtcggctaccaacaccccttcgcagacgccgcgcacctcgttccacctcaatgcctcggatgtcgccgctgtgaacaagaacgttgtcctcactcccgagaacgccatggagatgctctcccagaagggagccttgggccacatgcaagccctctcgatggccaggatgtagaatcgatccatccacacacgcacggccttctgagaagtgaggaacccctccccactttgcgatagatcattatccaacggcggtcaacactagcatacccttccttacacccagcattcatattcattctgtactatacacgccgttaataaaccataatataacatatttcgcatcgctaccactttcttttgaacgtcaggccaacaccgtctagcggtcagctcggcgctgtagagtttagacgcgctcagtcgcttcgaaacacgtcgttcacgagatgttatttccttgcttcaaagagaagaggtccggagctgttgaggtgcaggatatctctgcgcagggctacgacgttgaatgtttctcagatgggtcgataatgaccttgttcgctcctggtgctcgtttatacacaatcaatatcggaatgcggaagatttattattgacaagtcaacagtttaagcacgagcctgggcgacggaggcagcaatgcgatccaaatcacgctgaccatcgacggtgatcttgcgtccactattgaataacaacaaggaagaaaacagcaaggtgtgcgcgtcagaaacgatatgccactcaatacgccaaaaaaaaacccccccccccagctagtctgtcatatcccaatgaaccacaagcaaaagaaaactcgaacaaaaaccagaatacatacccgttctcatcagcctccaaaacgttgatcttctccaaggcctggaggaccttgcgagcgatggagccggaggacttgacgtggtgggaggggcgggaaccgcggttaaccgtaccaccgtggagcttcttcaaggcaccaacaccgacgccgcggcggaggtagatgtggcgggcaacggaggctatgagaccaagagttccaaattgagtagtcgggtcagttccttgatcatacatgctactttttttttggagctattgtacgactggagttgctgctggtcctgtcaccaattgttgaagtgtcctcgctctctattgaatgcctttcaaagtgcgtgtaataggaatagatgccagtagtgtccagggtgcccacagtgtcgaccaaaagtcctgttcggtctgctcctggagcccttgtggcccaccaccggtaagaagcgaccgctttcagtgaacaactctcgagcacgagacaagtacttcaggcggtgttctgccgctgcatagcaccacagcacaaaggtggtactggtggacgtctgctaacgtcgagttcctggtgggtgagatgaacacatgtcgcaaagaacgagtcgaacatcaaggatcatagtagccccatgcaaattgagcaatgatccattccatctgcaatgccatgaattctgtgcgaaaagatgttggtgctgatcctgagccatgatcgaaaagacagccctctccatgatgactagagtagtgaaggtctggtctgttgaagcattacccgcgcgaatgtagaaccagtcagggtcatagggagccaactccttgttggtgccggtcttgacaatatcgacccacttggggatctcgagcttgccggagctatagacagttgattcggatggaaggggtagagatcagcattcctggtctttttggtgtttttttgatgattcgttcgccatggatatccagaatccagaatggaaaatgatgcagcgtaatcccatgatccatgattcgacaaaaaaaaaaaaaaaaaagtccccgtctcgatccagatgatcccgatgcactctctctccgtgagtcccgggcgatgaggcaggtggaagaagaggagacactcaccgcttgaggtaagcggcgtaggcacggttgaagtcgtgagcgttgatgtcctgcacggtgaccgagtagagggcagccattttagcgaattgtgaaaggatttgcaccaaagagcagaacggatacaaattttatgtccctcgacggattttcgcatccagcgagatgacagggtgtgaaaaaaaacaacaatagcagtgctcggtgtgccacccttaagtcgcctagcctaggtagcatttgctcgcgatatcaagacagaaacaactgtttattgaagacgacaaacgaggatcgtctcgcgagagtaagagtcgagtggatgtcgcttgctcacatcatcgcaacaggatcatcatagacggcaggtcggggccacccattgcgctgataagattgggccagatagtcattcgggtcaaagccccggcggcgcagtggggagttggtgggcgccacatccttcccttgagcaggcagtgtctgtgtcaggaacgcagagggcgaaggaagatcttgcgcggcaatatcgcctatgggagcagccgagaccggcgtcgaactcaaggccagaaaggagacgacagcgaggaccatggacgatgcgacggggcagattggagtcagtctcattgtgaatagcgtcctgggtttgtgtaaagatggattgtccaggtacagtgaggatatgattgatttgttaaaggtgaaagtggggagggaggccttttaaaagcgtttggggtgatatggaagggacagacagccagacaggagtcgtcgccaagcacccagtctggcggtgcgccaggaaaaggcgagcaaatagcgcaaaggtcctagcccgcaagagcccctttaatgaaggcttttcccttgatatccgatagcaaacgtaaggtccatgtgtgtctttatgagccggtgctctcagaaaagaaaatggccagagagggaccatgcgcctccttgttccttgacctcgacaatgttgtgctcctggacatctacatggaccggcacaacagagcagcaagtgcagtgcaaccgctgaagcgcgaagcgtgaaatgtgaactgtgccatcagtagctagagacatggccctagatgtgctcaggtcttggtcttggaggtgcgcctctctgcgcttttaagcattgtgttcaccgagaatctctggcaaagcaacacatcatgcccgagaagggtcagcagagggatgaaatcaaggctccaagacccagatttctggtaagcacgaactccttacagcttttcgaggatttgtagaataatgagagggaagcctcaaacgaccgagtggtcgcgttaagaaccagcaagggctcaagatgagcaatggctgggaagaccaaggagacaaataccacaacccgccatcgttcaaacctcgtaattccactcacagaagactatagcctctctcgagtagtaaatcagcgagtactccctagcaaaagaaaaaaaaccctcctgagcttagatttgcgacacctgtacctacccagcgctccagcagaggtcgtaaatgtataaagacccggcttgcagatccgggagaatgggaaaaaaattacctttcccatctacagaagcagcacatcaaccgagcacagtagcgcccaacactttgccaactataacaggaacgcatcatctcatcctatcagcagtggtaaaccatgaaaatctttaccgctctcgctttgacgttgtcagtctttgctgccacgacatcagccatgcccgcccctgcccctgctcctggctcagccctactgggccctttaacagaagtccttcctctcgacgacattggcggtctcggcggccagagtgcatctgccatgaccaccgagggtaaccctctaacctccctcctcagaaagcgcggccgcaaccatctcgcggacatccttaacgcgctcgtgagcgtgaacacccaggttgtggctaaagcgattctgaaactcaagcttgatctgtgctcagacattcacgcaaagatcaacgttcgctcgactggaattttgacctcggatgccgacgttcttgtccccaagatctcggccaaggtgaaggctgagattgattctgctgttaacacaaaggtcgacctcgatgtcaaactcatggtgctggatcggatccaaggtcatggacgtcgatgcatctccaagtattgctcgaaaggagacgaccgctgcctgcgcaagcatgcaagacacattgtgagcgaggtggagggcctgatcaaactcgatatcgatcacttgtttgcgtccttgaaagcgaatctgatgacccacatccgtgccaaagtcaagatcatcgtccgcgagttgggtgtcaacttgctgttggagaaggtccatgtgcaggccacggtcgacgcggtggctcaactggatctgcatctggatctgtgcgcacatcttattgtcaagggtctgcatgttaccgtgttcgcaaaagtcctcgcgctcatcaagtcgattctctctgggcttttgtaaccctgcgaaaacggcccaatcttccctttatgcccccttccacataccccctcccatcatcgcattctgaactccagtggcctatccgtggtggtctgccactgttccgatatcacactctgaacacatccttcatgtatccttggtgcatttctccttcttttccttcttccggcttctggccatcatgatgattttagttattcagcatacgaacaggttccatattgacattaaatgatggttgaattgcactgctgtcgcagcttgtggagataaaaatacaaaggcatccatagctcaccagccattcttgatgtccaaaggcggttcaacctgcccgcgcaagcgctgcatccacttttcatccccagcttgaagcgtgcgctgtagttcattcgttacccatctatagcccccaaacagttagatacgtatcaaaaaaccaacgaaaaaaaaaccccccctcctccctccctccctccctcatcatcaaatgggaagtcgtttgcaaaaaaaaccaaaagctaaggccgagtttcgacttacatgatgatagtgttatcgtcgctgcaagatacagccatgcccgcttgactgggatggacgctcatacaacccgagtgattagagtgctcatccaggaccgagaccaactcgccagtctctacatcccagaaatgtagcttgccgttctctgatccagcacacagcagctcctcattacagcccgcgaaggccgggacgatcataaagacgtcattgatgtaggtttcggcctcgaacgatctcagataggtcattgtcttcaggtcgtagagcgagatctgtgctgggcgatgcagttcctcatccacctaaaaaaaaaatagaccaatgctggatcgttaaatcaaactgatgtctcacataccaacctccgatttcaaaacctagttacacctctacacacccctcccacccctcccacccaccgtttcttgctgaacataccttggaggagacggccagatactttccttgcctggagatattgacagccatggtcctgccactcacttcatccacacggctatggatgggcaaagtcacatacagagggcacaacgattttcgtcaagattccgcgtccactctcacacatttcgttttgcctgctttcagacatgcacttacgttgaagacacagtctcccccagcgaaaggtgctccaaagtgtgggccctggtgtatatcaacgcctcatccttgccagggatcatcctgatatgctccgcccggactgccctgggcactgctatttcacggatgatctttcctttcgcgttctgaggacgagaaagcgagagagagagagactgagtgaatgaacaacgtcgtccagattcgttcagggatgggatccacattagtgtggcactttacccatatgcagtagagaccgtcatccgtagcggtcaggaaccttttcgagtccgagaaccagcttatggacgagaccatgacaaactggccattcttggagtagctcttggtgaacagcgtctctcctgtctacagaaataagatggacgtgcgttaaagcgagcgatcgaaagtcagggagggagagagagagagaggagggggagtagatatcttaaagttgcgataatatgtttctggtctgtttcagagaatttaccttgacactgatgaggtgaagctccgggacgaaatctggccgccgcaagtcgtatccaaggttcgccaacaggtactggctatcgggcgaccattcaacttgagtgatagtgcgcttgtagttgaaggtcttgtaaatacgtggttctggactctaaagaaccaaaaagcaatatatgagcaacggagaaaaaaaaccccccagaaaagatcactcatcattggggggtcagggaaaatctcgaatcagtgaatgaactgagacggaaacaaaaaaaaaaaacaaatggagctgctgtgttctcttgttcccatcgactggttacacaaagcaggctgtccacgaaccattatatcatgccatagtgcaatcgtctggtcgagaccgatggaggccaagaactcgcccgagggtgagaagtggacaaaccagcattcatccaaatgataatggagccgtctgcgaaccaagtgaggaaccgtcgcgcgcagattgctcatgcgttgttggcagagcaacgcatccatcttggtgctattgatgtcatccacgagtcctgcgttgctgtcgccttgtttgctgtcacagtatgagcaggacagaggcggtgaaagagtggctgatgtgctattctggtgccatggctcgccttgagatgcctttgtcgcgttcactgtggagagctgctcttcttggggtagaaagtgagactgactaggtcttcttcctgttcttagcgccaaaagttccgacccaagagacgctgtgtttgagtcaagattgtccagagaggcggactggtgtctgcactctggaaggtgatggcggctgtgagaaatttgcgcttgctgcgaaaggagctgagcaagggcatgatccagatccagatcctgctcctgctcatggccatggtctttgcttggtatagcgagctttggaagtctggcggttgtgtttgcagaggatgagggggcatattgtttacgcgggggaggagacagtgagacggacattttttttgttcgctacgcgtttgggtgagacagggagtttagcgctcagggcaagtgaggtagggttcggaatatggtgctgaagggctgaccaaagaccgatgtcgattgaagagttgaggaggaggatggatgaggaggatggaagatggaggcaatgaacgcgaaagaagatcaatgaagaacgtcaatgaagagggtccgcagcacaacatcccgcccgttgttccccaaagaccttatttgtcgcaccttcttcctgtgtgtggatccgcccttcacacggagcccacaggggtaaatcgtccgatcccatcttagatgcgcctcccgcccacttctcgtcttgttgacccgccccacactccatagactgcacacacgcaaggggaaaaaagtgtctcgcctgccacaggtgcattccaagagagcagccttacctgtctgtttacctgtcagacggcagcgggagacgcgggtccgagagactgggccatggttggtggcagcagcagagtgttcaaactcctttcttgctttgccctccgtgtgcgttaccctacccgatttaggcagcattgtctacattgtgcaggtgggcacaatcagacgctatctgccatcatctcgcgccccaatttgtttgtgtgttcgccaactgtcgaggtgtttattttcgtggtcgccaagatcgagtgctcttgtcccagggctctttcatttccttgtctcccgaagaaggtcaccagacggtccagcacagctatcgtacagcataaaaagtttcaataatacaatggtgttcggcctctattcccagtcgtcctcgttgtagttgtcgtaatcctcgtcgtcgacctgagagtagcccatcctggccatgaacgactctggcgcgtcataagcctcctcctcctcaacagccacctcctcctcctcctctccagcctctccattggtttcaggggctggagtcgcaccggcctcgcgttctgcccgcgtccttgactttggtggtgcaataatctcatcctcgtcctcatccggcaacacaagtgaggcgtcccattgggagctacccacactgcgcgcttgcatcgattgttcccttgagacagtcctgcttcccgtcggtgttgctgagaacttgacgacacttccgcccttgtttttgatcattcgactcactgacgccagtcggcctggacgggcagacccttcgcgactgggggcgatggaggactgtctcgacctggagggcgtcttcaatccaggttcctcaaaaatggacagtacaggtgctggtgacccctcattatagtacactggctttgtgtcgaaaaggtcatccatggtctgtaaagcctcataattgatcttcttggacttttgtcttggaagctttggctgaagaatgttcttgccggcttctgctgcagttgcggatggacctggtgcgttgcgcttgtttttctttcgctacagagatgcacaagacgcaatatgaaaacaactctgtcagatcccgttccttgtcatgcgacatattgaaatagtttcaggcacaacgtactcctttcttgttgtggacaacgccattgaggcgttccttttctgcccgcagtcgcttccgttcttgttcaatgagataatccttgttaagctccatccagatctgagtcttgatcttgacctcttcgtcgttcaaaaggacgccttcaatctcgtcatcatccacgtcgtccaggtcctcgaatggaatcaacttgcgggcctcatcctcagctaggacgcaggagaagtcatgtcacgtcagtagatcacagtgaggacagagcataaaacatggaccacgctggactttcacataccgtctaaccgagcctcttcttctcgaatgagaggattgcccatagcagcctccatctcatcggccatttcttcttcatcgccctcctcctcatcctcctgcgccgcttcttcgtcctcgtcctcagcattctctgtgccctccttgtctgctggttctgtatcttcctcctcctgagctgctgtcgcttgagacgattttgaaggggctgcggaggtgatcattgttcctccagtagttgtctcggtctcgatatggccttcctcgagttcatcgtcgctttcttttacgccctgaaggtcaatcctgtgtgttctttctcctcgtcgaaggatctcttcattgatctcgtcgtctgcttcctcatcctcaccgagttccaaatggcgcctcttcttggactttgagaacgcaggaggatctgcggcgtcctccagccaaatctctcggaattcggctacttttaattgacccgaagatgtggccgcgaactcgtccagtctgtatgtaaacatattcaagatggcgaacaaaaagttagtcttcaagtgcatacttggtgccaaacgcgcaacgtgctcctgaacgatgactcataccgtttccgcagtgtcgactcgccgatcttgaccacttgaatgatttcctgctgagagcgtctataatgatgcattctagcggcaataagcaggcaggctccacagataccggctggtcgacgtcctgtcctgatccagtctctgtccatgcgggatactaagcgcagcgcatcgttggccacacgttgcgtatcctcgccaaaatccagcatatttgcgaaccgggagatgtaaagcgatgggtccactaagggcagtgtgaggtttagttgtttggagaggtgcagaaacgttacgcccaatttgaagacattgagctacgaggcagttgaattgagatagagcggcagacatgtcagcgggccactgtagtacatgatttactcagacgatgctcaacaacacctgcttcaatacctgcagaagctccgagaagtcaatgagcatatgcgtggtgcgttccatcctgcatacgatgtaaagacagcaggcaacaacgtggtcgcttcgacgaccttgaataaagttgttggtgatagccagattgaagtaccgctgtgcgacctctacatgatgctcgttgagcttcaaaggaacagccatgttggcgatcctgcgccgggcggcatccagtgttttttcccttgattcctggctagtttgtctcctgcctggtcccgaagttcttgcaccagctaaaaagaatgaaccacttcgtttagaccgctatttcgttgtgactttgataccagtcatatgaagaaaagctaataggctatattgcctacctttgccttcgccgacaaatgttcctacgacagatgctgctcctccaccgctttcactgaaggagacctctgcaatgattgtgttttcttccaggacctaaggggcagcattggtatggttaggaacaaggcgcatgtgcagtctagcaatgtctcccgcccgcacaactctcaaaggctaagcggtgcttgctgggtcgcaaggaggtcgaaggacttacggcaccgcagttggtacaggtggcatttccctggccggcatcgtactcgatgctgtttccaccacagtagggacaggccattctgaagagggggtgttgttttgctgctgaggtaaatacagatctttcgcctgcttgtcggattaggaagggggtgctttcccggttgaagtctgttgacgtggactggtggagactgtgtagtacagtggaagagctgaatgcaaacgagcgtgaggtgggtcgagcaagggtggtcctgaatggaatgaagtggtgggaaccaaaaaggtgtaggagggttcgttctggccctctgtgcagagagaaaaactatctcgtggcttggcttttttttttttttttttattccttcatactttggctacatgttggcagttgagcagcaagctcagtggatgtgggatggctgccaggaacgagtaacctcctcgactgtcttgcctctggtctcgggaatgatcctgttgatagccaccgtcagtcctcccagcaggatgaagaacatgtagaacacattgccgccccaccactcctgcaactttagaaacatcaccgacacgcaaaagttggtggtccagttgaccgacagcgcaaacgccgacgcactggccactgccgtggtgtcgacaacctcggggatgatcaagaacggaatgggccccagtccaatcgcaaatgacgccacgaatgcgataatcgagaaggccgacagcatcgggatctcgtagttgagcgacgcggccagcaggaaagaactggctcccatggccatactcgaggtcataagaagcgtccggcgaccagccctgtccatcatataggctgcgatcaaggtcatgatgacattcacgatggagatgtacaccgtaatcatggcgcccgacgaaggcatgatttgagacatgatcgccgtcgagtaaaagatcactccattgatgcccgagagctgctgagagagctgcacaattagcaggatcaggactgggcgcctgtatcgcggcatagacacaaactcgaccacagacaagcctcgacccgcgttcagggcgttgaaagccttttgttgcatcggctcctcctcctcacccagtcctgctcctccaactagcaggccctcgctggcttcgttcagcagcgggctagtgcctccatgcccctcttcctctgctacaaccgctcgatcatcctgcctggtccagtcgcggatctctttagtcacatcctgtcgtccacgaagaatctggagtgcttgtttagctttgatagcaccgccaggctgcaaagccaagtatcgcggcgactctacacagagcgggagcaaaaagacttgaaggacagagagaccggcgccagccaagaggattacgcgccatcccgtcggagtggagtaatagagcccgaggacctgcgaaaagagaattcccacgacgattcccagctggttcatcacccctaaaagcgttcaaaaagttgaaagctaaatgttagacagggcagcatagtcactcgagcccagttaggtccctgaacgctactttacccaaggttcctcgaagctctggcggtgaaacttcggccaagtacatgggcacaatcaccgtcacggcgccacatccaaggccaatcaggaaccggccaaatagcaaggccgtgtaggtggaggcacagcccatgatcacagagccgaggcacagcgaggcgttgttcaccatcagggcgcttcgtcggcccagacggtccgcgagcctggagcccacgaagagcgagccaacaaggcctcccagcgtcagggtcgcgactagaactgaccattcggcattggtcatggcaatgcagttgggtagagatccatccatggtccagtccttgatatggctgcccagcgtggcaggatccggatatgggggctcctcgcaggtggtgatgaccttttgaggcgagttgagctcgcctatatggtggccatactggaatgagcccaagacgatggacagtgcgttcagaaagagcgctggagtagccatggtggtggcgtgtcgaagggtatactgagcttctactagcttgctggcttgcgtgcttgctggatgggctactctactcgagttctcttggctgatttgccttgcagggcgggtctcgtcgggatggaaaggtggatggaaaggcaagaggagaggagtggtgtcgcgagtccagactgtgggcgcaaggccacttttgagcaggggggggggggggaattttttttctttttctgtggctcgaggggcagcaaaaaaaagaattgtcagaaacaggggctggagggccatggtcaaacattgaggaatggtgcatataaagtgttcatgaaagtagtggttcattgtgaagatatggagaggaaatggctaaaaaggagacagacatgacttagaccaacccagccttctccatggcggccctcatcaagactcccagcttggcagggctctgcgaaacaacgacgccggcactctccaaagccttgatcttgtcatcggcacctcccttgcctccagcaataatggctccagcatgacccatgcgacggccgggaggtgcagtgcgtccagcgatgaatgacacaacaggctttggctgcttgcgggtcaagttgtactgcttcaggaactctgcagcctcctcctctgcgctgcctccaatctctccgatcatgatgataccctcagtgttaggatcctcgaggaacagggacaagcaatcaataaagttggttccgttgaaggggtcgccgccaattccgatgcagagagactggccaaggccgacctgggtcgtctggttgacagcctcgtacgtgagggtaccagagcgagagacaatacctatcgagcagcgactttacgtaagactctagtttttttttaagctccagcctcgagtacgacctttcttcagagcaggttctcctaccaatctttccgactttgtgaatgtgaccaggcataataccgatcttgcaagcgtcaggagcaatgataccagggcagttgggtccaatcaagcgagtcttctcctgagacttcagagctctgacaacctaaaacggggaatggcaaatggaaggctgctaagaaaagtcgaaccaggcacgccgtcaccattcccttgtgtcatttctacttacgcggaccatgtcttgctggggaataccctccgtaatggcaacgaccaagggaatctcggcctcaatggcttccatgatggcaccagcagcgagtgggggagggacgtagatgacggaggcgtcgggcttgacctctttggcagcgtcagcaatggtgttaaagacaggaagtcccaagtgggtctggccacccttcttgggggagacgcctccgaccatgttggtgccgtactcgatagcctgcttagtgtggaaggtaccctatccagttcagcagcacatatgttgagttaagagactggcatggccatatagtggcactgatcgcacttgcagtgaggtgttgttgaccccagtaggctcatggtgttcggacgtgatgtaatgagcgcgcgtctggagaccactttttcccgctgcctcgcgtcgcctcgccatttcataaagtcatatccattggcatcccagatgtgagtcgctacctgcttgccggtgagaccctggcagacgaccttggtgttcttgttgatcaacatgttcttgaccgtcttctcgtatccagaggccttggacgaggcgctgaacatacgctgggcagctaatgattaagagttcatttttgcataaagcagaaaggcaggtaagtttgcgctcggggcacgcggacgtgttcacgaggtatgatttgcggggtggtagcagcaaatagggtccagataaagtgctgagcggtcgcgctgggtagaaaaaacacgagggaatagggcttcaattgaatgaatgaccttccacgtcgccagttgtcctggccctccgtcgctcttggccatgccaactcctccgcgatgcctctttccacgtcgagagcttgctgcatttggtgagtttgtttcgagactcctttgaatcccagcgccgtctaatccagcggtcgactatttttccccacgctgcattttagcaggaagcggccatccgaccacagcacaaactcgacgttgtctcagggtctgcaatgctgcgtcgaaagggtctcgagacgatccggttcgctcctctagagaagcatcaacgcgaacttgccttttgtggcgggagccacggttctaagagaggcgagcattgtgttgagtggggaggaggggaaggggcaggtgaggacggatgaagaaacagaaaggcagtaaaaagatggtcgatggggaaaagcgaggacgtcgagcggagcgcgaacagaaaacgaaaacatagccaaggggaatcacgtattcgaaaggcacgcgtacgtgtaaattgatcgcgtcgttcgggaaagcacaccgtggatgtaagggcctctgatcaaacacccatacaactcctcgctcatgagcctggctgctgccttctgggtaagcagcttgctgccggagactgatctgaaggtggcaagcagcgtgcgcatcgaaagcccgtgcaaggtggacggcctggccaggacacagccgtattccttactcggtgtcacgtcaccctaatttttttttcatttttgcactctcagcccggcgcgctttattccgcacattttttctggaatttttttgtttctctattcttcaattcattacaccatgttgcgcaccaccaccaccaccgctctccgcaccttcaagcccgcccaggtctctgccgtccgtgcctactctggcaaggccctctccgacaaggagaccgctgaggagaacagatacgctcgtgccagggtacgttcgttgcttcaccctgttccgatccaccaacaagaacgcgccatggagtggaattagaggaaccaccagttgcagtactaatcaaccttgattccttgttatgcttccttgttgtacaatggtctaataggagcaggagcagatcaagcagctcaaggaggcccttgccaagaaggagaaggagattgaggagttgaagaagtccaagaagtaaaagcttgagcagccagcaacatccgccacaacattgctaaaaggaaccttgctcgcgcgatgcgtgtagagtagtgttattaaaacaagtaatggtcttcatacggtcttcatacaatatcgatccaatgctgcagcaatccttcctgtggtgcggcgatgacacgtcacagaagatgtggtcgctcgcatttggtgtactcagctcccttttcagctttgttcggtcgtcttgactccactttgcaccatcccactattcattcacaagcggatccacaagcagacaccaagcgccgttctctcgcctctccacttttcattttttccagctgggtactgtaggctgttcacagcaagcgtgtttgtgtgcatgtgtgtttctgcgagtgtgtgaatgtgcggtgcataaggggcccagtaagctgattgaattcgacgtcctgtcttgtgccccgatccctcctcgctcccttgtctgtcccctctgtcccctctgtcgccgtcctttctttcctcgcccatatcccacctgcacctgccgcccatctgcgactcattgtcttcccacaggaacaccacagacactgactccgccgcattccctcaagccagcaacacccgtgaggcccacacaaggctctggagccaagcaacggagacgcaccctttcacatacgctcgctcgctcgcccgctgtcaacgagcgcatcctgtccgtacaccgccaccctttgacccctcttcatctcggcaagtagatcgatggccgcccacacatttgcccccgaggatgccttgcctccgccaaagtccgctgtcatttacagcagggatggcaggaagaggagtctcaacatcgacatgaccaagcattttgcgccaccacctcatgaccagccgatggcccctcccacgccctcccaagctcctgcggcagggcctgcctcgacccccagcagtgcagcagtcgtcaatggcgtgcacggcgcaaatgctgccaccagtatcgactctacaggtctgttcttcggcggcaccaattcctctcacaagaaaaagaaaaagaagcgcaccaagaagcggacgctggagcggatcgaggaattggaccggacagcaggctacggcagcagcagccatcatgctgcggcccacggccacgagcatcatgcagactgccatcacgaccacacgcatcagcgccaccagcaccatgactcgggtcatcaccatcaccatcatcacgaggacgaggacgaggacgacgaagacttttactcggacgaggatgcctatgatccagaaactcctactttctcaacttctacaggcgcagccgccttgagtgggcaggctcacgagggtccacagaccgccccagcagccgcaagcaacaggacaaccgactctggcgcctcaaaaaagaagagaaaaaagagaaaaaagtcgtcgactacgggcgcgatgcccacgatttccaccagccagcacagccataaccatgccaatagtagccacgcaggttccaaggctgttgtccaatccagccatcgcaatggacatgaccatacgtcgatcgtcaagcacatgcacgacaaccatgcgcaaaacgacggcttttggcactactctgacgcggaggaacggcaacggatcagagagttttggttccagcttcgagaggaggagcgtcggtctctagtgcgcgtagagaaggaagctgtgctgaaaaagatgaaggagcagcagcggcactcgtgttcttgctccctatgcggccgaaagcggtaagcccgtgttttaggaggtcatgctcagtggataccgccacaaacttttgagagcgagatggccgttcattttttttcggtacatgggtgcagtttattttcctcttttcgattttgctgatgagatgatcgctattgcctttatagaactgcaattgaagaagagctggagctgctttacgatgcctactatgacgaattggagcagtacgcaaatcagcagcaaccagcggatggccatgctcttgcctaccctcagcactcacccgggttcgaggacgacgagctttcggatgtatcgagagcctcggacgaggacgatgaggacgaggacgacgaggatgaagaagacgacgatgaggatggatacgaggatgaggatgacgaggacgaatacgaggacgacgtcagcaatcgtaaagcggccttcccctaccgcagcggcttcccaaatacgctccaagccaaaggtagtgagacacgcgacagctgctgttacaacttcacatgcgcgcacagaccttccactctcaacgccatgaaccatttagattttggtcgatggcacttcctgactcaactatctacatcatgtggactttttttttattttctatatttattttttaggcaacattctcacagtcgccgaagatctgcttgaaaacgacggcaagaaatttttagagatgatggaccgactggcggatcgcaaagttcaacgcgacgatgatctcatggacaaccggggtgtttatgaggaatacgacgacgatgaggaaggcgaatttgaagaggatggaccggaagaggtactgtcaaggcgcagtatttttagaacacgtacttggaagcgtcgctagcgtcctttctaatcagaccatgttcttttttggcgaaattaggacgcgctcacaaaggaacagcgaatggaagaaggacggcgaatgttccaagcgtttgctgcaaggatgttcgagcagcgagttttgagcgcctatcgcgagaaagttgctcaggagcggcaagagcgtcttttggcagagttggaggaagagtcgcgccaggaacaacttcgagaggagcgaaaggagcgcgagaaggagaagaagcgagacaagaaaaggtaaaccattgcacaaccatgtaccgcagatgctcaggttcttgaaggtacttggacgtttctaatagtaatgtcgtccatattatccaggctgcaacgacaacaaaaggaagaagagagggcagccaaggaggctcagcggttagccgaagaaaagcgactgctggaagagcgcgaacggaaactggaagcagaccggaagcgacgagaggaggaaaggcgcgtcaaggaagaagaaaagaaagcccgagaggaagagcggcttaagaaggaggaggagcggaaacgcaagcttaaggaggagaaagctcgcgaggccgagaaggagcgcaaacgcaaggaggagcagcttgcaaaggaaaaggaggagttagaaaagaaggccgagcaggaagcaaaaaggcttgagcgcgagacttttctgaagcaacaactagcagaggaacagcggaggcaggaagaattgcgtcaacaagaacaacttgcaaaggaagagttggcgaggcaggagctggaaccagagcaaggacaacccactgagcaggaacaggaacaggaacagaccaaaacatcaagtggcagccctcagcagcccgctgtagcctcgccagcacgtggaaggtctgttactgccgactttgatgcctctggtcgttcacaggcatcgcagagtcggtcgccagttatggcctcgtcagcatccccaaaccatggattggccgcaacaggccttccttcccatgggcagtcatcgcctatcggaagcaacctgtggtcaagtggctatccagtccaaggcgttccccaacctcagcacgcggtctcgcaccaacaccagatttttgcacaaccaatgcagcaagggctctttagaccaccaacgcagtttgggcagatgagtggtgagcacgaagcatttcattcgcggatggggccaggtgctggacgtggggcgtatatggctggatcgtcccatgccacgcagtcatcttttcaagtaatgcctcagcaccaaccgtcatcagcacagcgaggtggtatgcgctcgcctgggctggcgccgattggatatgggcagggcagttctaagcagtatctcaatctgatgaatcccagtaacgcggcaaacggtcttgatttgacgggcagcaatggatcaccgctccacagcccgtccaccttgggagccatcggtacccctatcagctcctttggccccatttcaccgatcggacacgctaggaggacctcaacgcctcatggctcggtgtcagcagaagccatcaagcccattcagagaccagtacccatcggacggcccaaggaccacacccaacaagcaggtgccggcactatttcaaacagctttgatggaatttcgttgggactgtcaggactgacgattggctccgacatggaacggcggccgagatcgccacccttgaatctggcaggaggctcatcgctggatctgaatggcgtcgtgctgaataaggaccaatcaatacgatcagcgaatgggccccccgaaagccacgcacatgtcttttcgagtgagaacgcctccaccgcaggatctcgtcagctggatcactctctgccactcctcagccccggtggccgcggacagagttcgttcttttccaattctttctttggcaaccgtatgaacgggcatggtaatatgcgctactggcgggtatatttatatcttgatcttgcgcaatagcaagcacaaatctttcgtgatgttaactcttgcagcaatgtctgcttatcgtccttcagatcctttcctgcagtccgcagatttctcgtcgtttggtcagcagccctcaagtcatggatcactgcccagcagcaaccactttatgaacccttacccaatgcaccttccgtcgccaccgcataaccaacaacagcaacagtcgcagcagcagcagcaacagcagcagcagcagctgtttatgcagcagcaataccttcaggagttacagctgcagcaacagttgcagcagcagcagcaacagctgggccttggctcaccacctttgaacggatccagctcttggagcaggacaaacttcatgagacccccacatttgaatggattgccaggatccaatggtcacccttcaactctgggcatgacttcaccaacttcgagtgcgctttcaccgccgccaggcggcatggggcttcataacagttcacataatgccatgatgcctatcggccatcagcaatcgcagcagcaacagcagcagcaacaacaccagtctcatcaattcagtcatttccaaggcaacagcagtctgggattgacggttggatctggacgaaaatcaatcagccatttgccacccatgcgccaaagcggcagcgtggatggatcgatgatgggtgtcagcagcagcggcagtggtggtgttggtcaggcaatggatcatgagcggctctcgaatggatacccctcctctggatatgtgtcccatcacctcccgcaacagcagcaacaccaacagcaccaccaccttggtgccataggcaatactggagccccatccgggagcggtggccctgcaaataatgactcgagggatgtcgccttctcgctataatccttcctcacctcccctcttcgctgtccatctttctttctttttttttttttgtttctatcttctttcttctctccattttgatgattaccccttccctgatctatgacgcttttacccaccgtaataaaacgcaaaaacatctactcctatcaccaacaatgaccatcatgacctgtatcgtccccctcatgctgtgcctcctcctgacaaaagttttaacagttgtgttatacattgcagagaggggcggggggaggagaggaagggtattctaaaaatcatagtcgtcaatactactgctatcaccatcatcatcatcatcatcatcatcagcggctgctgaagcactttttttagccgctggcgtgacccttctaccacccaaagagccgccagcggggggaccatcgtcttcgagtcgatgctctcggtaatcaaacctgtgggtctttggatcgccgtatttcagactcgaccatcgacgacggccatgtttctcatcgtctgagcgcatcctggcatcgctgtggtcgtcgtcttcaggacgatggcccgtcccaaacagacccatgaaactggatccggaattgaaaaacgacgtgaaggtgtcaaagatgcgctccgatgcagctgttgttacggacggtgataacggctgtgatggtgatgaggatgatgagggtgatgccgtggtctggatgcctcttggttccgagtcgtccatgggtcgcttcatgctactcgctctgctaccaagtgtcgaagaggtcgagcccgcaggtgacggaggctctctcatgctctcagatgggccgttgaagacgtccgttgggtatataattgtatcatccgaatgagaagggccctcctgcggctcctgcggctccagtggatcaacactgatcgccacagtcctcacggtcgacttgtcaccctccgccgttgaggtactgtatcttccagtcgtctgtttggagggtgaggccatgccctggggtcccttgttcacagtccctggctcacctgtcctccggtggtggtggttagtgttgttgttgttcttcttgtgcaagtgctgttcctggtccgagaacgaagcctcatcactgctctcgcccgcaatgacgccatcgacctttctcagaaacgatgtaatattgttcaggaccccgcgtggattgatgttcaaggtcggactcgcgacaaaagacgatgtggacgtggacacacccgtcgacacagtcctcacggtgacaggaggccgctctggacgggtcgtggttgtcaaggacggggtcgaggtcgaggtcgatgccggtgatcgaagaaatcctgttgctgtctccttgcggtgatctttgacctccaacgacatcagcttgaactcttgatcaaaggcgtcaatgccacccacatacgacgatgccgcagaggatgtggttcgttccatgggttcttgttccgaaaggcttgaatgaggcgccttgttgctgatgatggggttgcttatggtgttggggtggccactggtcgggatcaccaattgaccgccctcaaacctcaagagacctcgtttctcggccgcgtggatggccgccagtttcttcttttggatcaggtcttcctcttccttgcgcaacgcttcttcctgagccgcgagttctcgggttatcctctcctgtgaaccgaaaaaagacgtccccccgcgagcggtaccaatataatgttaatattgagaattggataaaaaacgacgttagccaagctatgcaggatgtgtcagcaggaaacgaccgtctgtgccaacgaaaaacgcatgcagggacaagtgagagaaaacacatgtcaaccgaaacgtggactgagggtgtttgaaaaacagagcaaacattccccccacttcctcgtccgcgctgagctcattttgcatactttgcccaaaagcgtttttttttggcaatggtgcacgagcgagcgacatttttttttttgtcatacctgttctgcgatgagcgcatccacgtcaatggcctcctccgcatctgcctctgcgctgccccgtccaagcttgtcctcgtccgcactctcctgccaagtcatggatggaccctgtgggtttctgggctggcgcattcgtcgagcgggaggcggaggaggatgagcctggccggtccagaagcctgcttcgactctgtaaggtgtatattccatctttggatacattctcggtgcaccctgtactggtgtcgaaggaccttcccctcgacctgccaaggagctggtgtggaggtgttgttcccgcaatgcctctgcatcctcatcgctttcgtcgtcgtcacgatagggcgtgaagatggattttttggtcctcgatgccgacgacgcccttgcggttctactgcttcctccgttctcatcatcatcatcatcatcactggaggtatcgtcgcgatagggctcttctgccctgaatgggtttggtttccgttgacgatgaatgcctctggacccgagactgctgctgctgctttggcgttgaggaggatggggattggcctgtctcgagaaacggccgttggagggccaggggttgtatgtgcttgacccggacggatccctggccagcagcagcgacgaaggtcctagcgcctcgagtctagcgggactgttgcggtagtggccgtggtggtggtgaaagaggtcgtcctcgtcaccactgtagtcgtccaagccagaggacgagtcctggtcatggtaaagggcccgtgaggagagattgtcacgctgcttgcgaggcaaacatgaacaaaagatggagagccgttttggcatgtgtcctttcttctttcctgagaagtgaagaaggagagtgaagaaggagagtgaagaaggagagtgaagaaggagaggggagacgctgaaagtgtgaaaatgtcaatgcaatgaagaattcaggggtgttcagttcagacggacagaaaaagtgcggggatgaaggagaaagagaatgaactcaattctgcgttccgtttgctgatgtttatttcctctttgtcattccaccaccccacatgttgtcatatcgcaacagggcgggaaaggagaccttgcagcgtctgtccaagctggtgtgcaacagcagaagatagacgcatgcgaaaagaaaaaaaaagggcgcgcaaaaaggagacaagccagggaaaggacaaaaaatggggtgagcgactatcgcatcgtgcagcacgcaacaacgctaccatcttgccttccccgtccaggctgcatcaaaagggaaagcgatcggctgcaaaaaaaagtcctgcctgctccctccccccagcccatctggcggcgtgctcacagtaaaagcaacttgctggaccacaccacagggggtttttaaaagtccatgacaagttgcgctgtgatggcctccaacgagtcgagctcgatcagcgtctcctcggtcctcaagtcctcatcttcctgttcccgttgataggccgccgttcggtgtagtgcttcaaccgtaaacaggcgcaggaactctgccgacagctgcatggcatccttctgggctacaatggacaacaaccaacaaagacaaaaaacagcgtaagcaagtttgcgcatttcaccaatggctccacggcaagtgcattgcatccctcgtgccaccttacctttcgttcctggatctgtccaaacgcccttgaagatagcctggacggtttcctgtacaagatagacagcgagaatgtcgttcagaaacgacccttcatgtcgggaacactcagggggtgacacccgttggccatgagacttacaggtcgaaagctaggtaattcgtcttcctcatggtcttctccgcccgccgcctgacgcgacggtccagccacagcagcagtccttcgcgggagggtgggattccgtgaccgatcgttcattacatcttgtaaatcgccgtcatcgtccatcaggtcgtccacctcaaaactgcgccgcttctcctgccttccatatccgtacgcctgatccccgtcgctgtcaaagttgatgtcgtcgtccataagcgcacgcttggttgtgtcgggaaagagtgtgcgtgagcaaaagaaagaggaatggggtgaacgcgtttacgtgttggtggcataccaagaaaaaaaaaattcggatttaaaaatcggccagtcactgatgcagcagcactttgtactatgctgacactgacagcgatagcaacacgcgttacgcgacaccatcctcgctgcccagcgtgctcagcaacggccccagaagcccatcaacctcgtccgtcgacacattacagcacagtgcaatcagccgcttatactcctggtgcctcttcccctgctggctcttgagctgaaccatctgctccacctggtccctgcgcgattgctgcaactggctcaagctcctccgcagctcctccgcctcacgctccatggccaacacccgctccatatccaccgcatcagaggctcctccaaactgctgctgccgctgctgttccctcttcctcttctccacctccatctcctcccgcagccgcatctcctcctgagccaccatcccttctaatctcagccgctgtcgaagatggatttcttgccggatcatcccttccaacgtccgcatctgctcttctgcctgactcaactgcactgtcttgccctgcaattcttccacagtccgatgaccctcctgaatctctgtctggatactatgcaacagattcctggcgtccaacaaatcctgttccttctcatgcagctccttctcgtacgtctgcgtcagctgttccaacagctccgtcaccatcggtatcattcgctgggagtgccgacctcccgctgtactagaagagccatctccaccacctccatcaccaactgtcaaggacgaactcatctcggctgatccgcctcggtcagctcccagagtgtgggtagaatatccccgtcccgcctcgttcatgtggttcaattgaccgccatgtactgaatgaggtcctgtgcccgcatgcgaaggctgtgactggaaaggattccgtgacgatgaagaaggcggatagtcctggtatgaaccagaatagggcggacgatccgattgtggtacgttcgacgacgaggacgaaggtgggtatccaccatgcctggaggaggggggtgtgacggaccgcaaggccgacgaacgatgtccatgcatcctcaaagatgaagacggccctgacactggcatgctgctcgaaagacgaggagatgactggcaagcagtatggcccaagcgctgctgctcaatgctgctggcgccttcactctgctgctggcgctggtgctgttgttgctgttgttgttgctgctgctgctgctgctgctgttgagggtatgctgaggactgctgttgctgcgacagtggtagagaggagggtgggaacaaggctgaagggggcgggccagaaaggttgccctctgcgagcgctgcgtcgtgcataaactcatccgcatttcgaccagacttgtttcgaattttgacatctgcgccagcctccaagagcaatcgaacaatcttcttgttgccgatcctggccgcaacgatcagtgctgtgtccccgaccaagtcctgcacattgatgatcgacgccagctccgagggatgttgcgccagcttttcgagcagacattccatatagtaccgagacgcatgcaccttgccccgcattcctgcagtgaccgcgatgtgatgaaagaccgtctgatcgttcttgtcgatcgtaaagattgtcttttgtacgatctccaggagcgacgggaatgtcttcagatcaaagttgttggtaaacagcacggacctcatgagggctgtttggccctggttgttcacccgatagatatcggcgccatgcttcaccaagagcttcactattttggtcttggccatagccactgcccagtgcaacggcgtatgtccctcctcgtcgatgatcagatcaaagtccaggtctgctggaggctccaccaaaatcgagggcagagttgttgcgtccgacacaaagtagttgagtagcgtctcggcgtaatgactctgatttgagccagtggccattcccgtcgacatggacccttcgtcctcctcctgccatgaccgatcatggacgagctcaccacgacgacgacggcctggcgacggacgacgatcgtccctcgagtacatttcaacgtcctgatccgcgctgtgaccgtgctgtcgagaacgatgaccgccagggctcgcataaccagactgcttccgctgagtgccatcgtcctgatatcctataaacagctcatcgcccggccgactgggctttttccgtgcgcgttgtgaacgttccgatgatcgcgggcgcccccgatgtcctcttgagtatccctcaacatctgaaatttcgctagacgaattacgagatcctgcgggcgagggcgtcctgctctgagctgataaaatactcattgtttcgtctctgctaacaatactgcctactcgcgtgcacaaaccatcgatctgtgtgttagtctccttgacctcgtacatcacagaaacaaagagcagcgtataaacgggaaatacacggagcacgtaccctcacgagtctgcgcatcttgatcgtccatgtccgatgtgctcgcatcgtcgtcttcgtcgccaccaaaagtatgcgaggaacgatctcgacccgatccatcaatgacgcccatgacaggccctcccgaccgtgccgagtgtctgcctgacgctttcggctttgccttgctccctctcggcgctcgaggctcgcgtacctttcgcggcttgaatgaagctgcggtgatgtgtttgggtgcaaggggtggactgctggccttgctctggtattccagcaatggctttagcaagtccaacaccatgtattcctgacacagcagcagtccacgctcaaaaggtacccaagttcctatcagccagaaataaaagaatagttttgttttccattttagcacgcgcaaacttggaaacattcatacagcgtatgcgtagccactctcttaccttggtattttccgtatccaccctggactttctcatgctcgcccctctgaacctctctctccaaaattcgcgtccgctgaggcttgtcaaactcggccaccttcaggatctgggtcgcgttcagataagagtccgaacggcgacgcatcaccgctataccgcgacacatcatctcatacactggcacccccgaatacgttgccttgaacacctgagctcctccgcctcggttcccggacggtttcgagctggctgcgttgtcggctgcattcaccatcagcgtctgtggattcgatcctgaagcaaatagaggagaccccatgttaagtccttgtgtcggtggcgccataacggacgcactgagtgatggtgtcgctgtagcaggagctgtttgcgtggttgccgtcaagggtgccatggaaaaggctggggatggtaccgtcataggggttgagttgaatcctccgagagagggtgtaggcgctgcagctggcgcttgaagagtcgccgaaaatcctccaataccaggtgctcctgtagttgttgattcgggagtggttatcactccaatgacatcagtgttgggaccactgctagtagtgccattagtcgcgctaatccctgacagtgactccatgctgttcactgaactcgagcccatgtatggttcactcgtcaggtcactacttgctgacgtcggtggaaactgtatgccttgcgcaccagatatattattatggccgatgttgaacgtcgaggtcgtccctgatgaattcaatgcaggcaccgccgtttcagccgcctgcctttcttgggcaagaactagttgttccaaaatggcctctggctgctgttgttgctgttgctgttgctggttcaactcttgatgatgccattgcgatgattccaaaccactgccgagaattccttgggaggaagcagaagttcccaataaggcaacggcaggatccacggtatgggtagacaaggtgtactcgggcggctctcctgacgtctgtgtctggtgttgaataggcagggaggtatcctgcccaagcgtctctcctggaccataagactgagcaaaagtcgttgcattttgaacggaggctgtcggtttctgtggtcttgactgaccccctacttgcgtccgtgacacctgcgatgctgtggatttcggtcccttggtggtgttctccggagaagtggtctttttcttggtgacttcttggtctataacagcctgctgtgctgctagctgttgctgcagaaacatctgagaggctgacaaccgaggctgggttgggaatacagccgacaagtcatcaggctgcaaagacacgcctgcactgggagggatggcgaacgcagcgatggtgtcaccagtcccggctgtagacagagccccggttgagagtgcgatcgatcccggggttcctgtcggcaaggtcctcgatggcggtatcgcgacagtcggcatgaaaacatcctggctttggttcgctgccgccgtaggagtgctactgctgctgctgccgcttgtctctgacaaagctaatgatcctgcctgggtatgagacggcggccgacttgcagtcgacgtgtttgggatggaggcggatgacgttgtgagacttgacgagactgcaggtggcagtgtagatgatgcactcggcaaaaggaatgcagcgcctgttgttgtttcgtgagcgaatgaagctggcgtctgcagccctgactgtgcggaggcaagcgacgctgctgctggttgtgcggacactggcatgttgctactgctgctggctgcagtgccggtgcgttcatggctgctggtgtctcttgatgcaggcctgttcatgtcgcctgtgctgttgctggattccatgctgcagtgcacgatctggatgcgagtaggcgacggctctgcggcagataacaggattgtgcgacgaggaatggaaacggctgccgcagggggggtgtgaagagagaaagagagagcgagagagctgaaggggctggaggagtggaggagtggaggacaaacgacagcacggcgatcaaaagaattcgggagcgaattagattcgaggcatgcagagagtgaggacagacgacaaaaacgtgttgaagaggagaaaaaaaaaaaaaaaaaaagacgcgcgtctgccgccttgtcatttatcgcttttttttttttccctccctcttcacttgaaacatgcccagggaaagacagcccagagacgcgtccatcctaaagacccctcgtcatccagtcgacatcgccttgtggacatgcgcacgacagcgcgctgctgattagagaaggaacgcgcggcggcgcgttgatttatttttcagtcaaagagcttccagcatatctatgagcgggcacgcgtcttgttctaaacatgacaaagaaaaaaacggagtgaacaattcgcgttattagctttttgtgggttcaatacgttcttattcaaccactaccaccaccatcgtcaccatcatcattacgaccgccagtactgagggcaacagagcaaaagtcaacaaaggcacatattgctacttacaaagcatccgcgacagaacgcctcgccctctcctcgtgtgaggcaactggaatccaacacctttttgcactctttgcagttgagacacttcttgtgccacttctcattcttgggacctggcacctggtccatcactccaacaggttgctggcacctaggacagttcgtcacacccccaaactttggcaagggccgagtcctggtgctgaacagcgatgtcagcgccggcggctgggagcggaccaccaacggcgaggccatcatcagcacgggtgagctcgctccgtttccatcgagctctctcaagtcaccatttgcggatgcactagtgaacaatggagaaccaggtgcctgactgggcgaggaacggccgctagcactccgaggcgatccatatccagatcctgagcgcgacaggttcccattcgcgcctagagtaatagccatcatccccggccccgagggctccatatcagcaccaggaagggtcactgggatggccatcggtggcaccgggaagtggtctgaagccctggccacagggacaatcttgggcgccagtcgctcgcggtcgcgctcctgacagcacttttcgcactctacacggccgtcgacctcgaaaaaacgactagtactatggagcacatcgtggcagtgtgtgcatgtgaagcactggggatgatagttcattccagaaaaccgaatcgacttgtttccaatcaccatatggcattgttggcattttgtgaccaacccgttcgtgctagtcgttccagccaacgaaacacactggaatgaagtgatgcgcgacatataacgaagatacgagtcgtaagcgacatggaatgatcatgacaagagttattagcattgaacaaaataccggttcagcacttacgcttggatggtaaggtctgccaaagacaatatggaactcggactctgtaaagacctgcttgcaaccgtggcagagaaaacatccaatatggaatcggtcgccgttctgcaaccgaattccattctctgtgaccttctccaagcacttctggcaatggttctcgggaatggcagctcgttgaagagtgggactagcaagggaatcgaccttcactgctgggaagctgatcgcctccccgacagtgtttgaacgctgacgaccatgccgatgcaatgccgatgctctgttggactctggctctatctgcgaaccagaattcctggactccttagactcctcgagctccttgcattccttggcctccttctcgagcattgtgttggattgcttgcggggcgtgccagcaaatgcagttgagtatctgcgatccgcaaacaaactgttgctgtgcgaaaagatctggcttccagctctggaggaggtcgctgaaggggtgttgttcgactgagcttgcgacatccaagcctctgtccttgccctcaccatccctgccgtagacggtccaacggacgagcgagagcggacgcgcgtaagtctaggctttggtggctgcagttgctgttctgtcttcctttctgggaccgcagaaggtttaagtcggtccgcagccgaagccacaaggtccacctcggcagagagggcgtgcgggtacctgtcgaggactggtgttctacggccgggtgtttctgggcgggaactgccgcgactgtcgctgaggtcgagttgagagacaccgacgctcgtactggactgcgatggcgttctggaatgccgctgctcctgttctcgctcgctcggcaccggtgaagaaggccgtgagctagtgtaagagtgaactgagagggcagagctaggtctctgaaaagtcaagtggggactgccgctcgttccagtgggaagaggcgagagcgtggcgcttgagtcagcgcgcctgcgccctaagcttgaataagttgacgatgtaccactggtgtacccactcgaggccgaacctgactgtctgagcgatgctgcaaatgatgactgactggaggagctgtgggcggaaaggggcgagggcgaatttgttgtcatcagtgcattgtttcgatccaggttcagatccagacgcgagagactgagctgaggccgatcctccgctctagccgtgtcagggtcaacagaagtagccctagagggcaatagtgctggagagctacttaaggatcgatctgctggggtggaaccgccgtccttcagcggctgggtggtgtcctctacattgtgtgcatcgttgtcagcccctgcctgagccatgagacagccttcacaacagggccgtccacgcaggtccaccatgggattctgacagatgtccatgcgacacttgaagcagatgaagcaagccttgattaggagaatgaaagcaaaaggtagggaggttagaatcgcacatcatacggctcgtccggcaggtgcaaaaccattcatcatatactctgtcgaatgtgctcctaccgtatgccatgaccgcttgttgtgggtaatgtatgggtccgtcttggacatgacgggcttgaagcagctcgggcagctgcccttggtgaatctttcgatgtaacacttttcgcagtagattatggttggttttcccggttcgacaaagacttttgcctgtttagcgataacggtggagccaggccgcgttgaagtcagtacgcttgattatatcaacggagcatattcaagcgttgtatcggcgttcgtacctgaaatatctgcttgctacagttattgcagtgcttttgagtgacgagcgactgcggtttagacaagctgggtagggcagcagcaggcatggacatgcgctttgacggctttgagatacccccatcaaggatattctgatatctatttttaccatgcacagggtaagggacaggtgcagcaaaaggtcagtaatgggtcaagcctaatgagcgcaaagagtagaataagttgcattgtgtgcgcgtgcaaagtcggaaggatgatccttggcgacccctgactacaaggtgtgccaataacgattgttcttcacgtagtcgattccgctgaccacactattgtgtccattttatctccagagtatcagatgagtcggcgcaggcgcaggcaatcccactttgccaaaatacaagagtaaagaggcgatgagagaaggatgatgctgcctgaggggaatcaggtctagttgcccctgaatcgacccatgcttcgcgctgttttctctcctttgttgcactccgcgtgatctgcagacgcaataaatacaaaaaaagaagaccttgcgtgcgtgtgtgtgtatgtatgaatgcctatggaaatatcccttgcgacgtcgttgactcctggatgctgtgttggcaagggcactcaaggagatgacccagccgaaggacgcggggacagggcctctacttacgcattaatccacggatcgtttctggtccctgtggaggcaagaccgcttgtgactgacactataccgcgaatgcgagcaccggagagcgagaacgagcaagaggtcagagcgcgtttccgtgtcctgcaagtcagcactcctccattcacagctgcatgcgactggactatgccatccactagtgtacttactgactgaccgaccaccgcactttagacagttggccccgtggacgaggtcgccgcatcgatgacagaatcccatgatttattcagtgtatctgcagcgttgcgtaaaggagggaggaagattcgagactggtaggatgtcggtggacgagagaggaagaaacccagagtaaagaaagtctgcgcgggtcgtcgagaaagaagtggagatcaagcctttttcagttctttttgtttttgtcgggttgacgatagcaggagcgagtatgtgtgggatggagaacgtgagggtggaagaagcttctttcaggtttcgagagggagcaagaggcggcacaggaaaagaaagagcaggacggggaggttggataggaagacgaagagttgcaggagtgtggtcacttgtgctgacaggttcagcgcgggtctgcaagtcctttcggcgatggtgtggagatgcagttcgtttgtggtgcagagcgagctgacgagtggtttgttgtcgagcggatgagcaacagcagcagcagaggggagcaaagagggcgaaacaaggaaagaagaagagaaagaaaagaacgaacgaacgaaagaaagaccagcggaaagggggggaatagtgtccactgatcaactgcacttgacttttatagtgcagctcgtcttgctggactgtagcattcccttccgccctgagatccgccccaacctgcagtgcactctgtcgccgttcctccttgctcttctctccgcttccttgtccttctcgtcgtcaccggaagcgatgacgctcaaggtcggttgtgccagttgcgagggtgtggtccatgctttgtttccagaccagacacacgcaaagcgtcatggaacagggggtgttgtctcagcgcgcccgtaagcggctgtggtcagtggtcggtggtcagtggtcggtggtcggtggtcagcataagaatagctgacagagcgagaccacacgatggtatgccatgccccgctatggacagcccgagcagagctggactggtcgcctgctcgtctcgggacttttccatctcaaagacagccgcgctcaatgcacgtagctcggtgcaagtacgttcaacacccgtgttacattttcaacgcaagtacaaatggcgtgtcatcaccaacccctatccagcctgcggcatgacctcaagtctggggactagtcacgaacaaaagaaaaaaaaagaaaaacactgttcatgtcgcacacaacggctaggtgcacaggcaacacaacttcagttacagtctggaaggaatgcttcaacttgcaagtgttgtgtcgcttgtttaggaccagaaattatgattactacagtattatcgatatgctgggcagtgcaggcaacacgtctagtgaatgtggaagcagttgttgcagctcccgcgcttgaagacattaggcgagaagtcagtgcactggcactcacgacagggtcccatatctgtctctgcagggtccggcgtctggttcgaaaagtagtcctttggaatatagcccatcatggacggcgtcgagggaactgccgttgggggtggagacggtcctgcggggcctcctgccatcatcactggtggtgacataggcgttggtgtcgatgcgttcgaaaacacagcgctatgcctcatagactcaacagcagcccggcgtgtagggggcggtggtgggggcatccttgtcccaatcgtagatgcccggttcagtggtgacaatgcggatgctggtcgactctgcggaggagtcgcgcgcggcatcgctgtgggtggtgttgcaagtccagctgcatgtccactcgctgtgccattagaagcaggtggcgcgtacgtcgagggttgccttgttgggggcggtggtgctctccttgccactggaacaggaaccacttcttcttgctcgggctcatcatagtgcactgtcggctccgtctcacgctcatgatacacggcctcgtcttcatccatgtaccggccagggtccgacgagtttgaattgatggatccttgtctgtgagtggaaccagagtcactgaagacttcctcgcagtagttggaagggaacatgccagtgtgacggacgccattggagtccacgagttcaccctcccaccatccttcatcaatctcttcaacaatacggatgatgtcgcccttttgaatcgagagttcgccttcgcctgtggcatcaaacgagtatagggcgcgcacctgcttctgaggtcgaccacggcttggtgggacaggcgggggagccataaacccattggatcgaacacttccgccaccaccactgttcttcctcgtctgtgctgcagtaggtgtcaggtgcgacatggatcggctcaattctggattcgcatgctggtttgtgttactgcgtcggaggtctgcgctcgatggtgctcggtccagtggatgtcgtccgttgggtattgagtgagtgcttgattgatcatcagagttgttggagcgatcgtcttctggttcatgcgagttttgccgactcagtttccttgggccagcattggtggaataaagagaggctcgagacccattgggcgaggatgcgaatgtgctctccgggattgcctccaaaatctccaccatcctgcgagcatatgccagctgagcatcgtagtatgacttgaggctgctcacgttgtcgtcctgcgatgaaaggcaaaagatacgacaattgggttgacaatgagtgaactgtatccatacaagtgtctcggtttcggtggcagtgccatacatctcaacgcaggtacttacttgtgactcattgatggtgttcattagcgttaggacgttctccctcgtctcctcgtatttcgccttggccgcctgcatttcctcctcccattcaggcttttccttcttggccttttgcaccttggcgagctttgtatcgtagtcctggcgtctagactgcagtttcttctgaagtgccacgtactctttcatctgcgcttgagacttttccaggcagtcctgatatgaagttccgaatcgtgtgatctaaatacgtatcatagcagagcagacaggatatgagcatatgtattttcaagttattgtcatagactctaaccaagtgagccacataccagttccgcctgtgctgttccaatgttctggtgtgcatcgcccattcgctgcagtgccgttcggtaggatgaaccctcgcggatggtgtagctttgagccgacatgctcatgccaaatgtttcaatggcgagccctttatgtttgtcatcgccctcaactcgcttgcctaaagatgtgtaggggccaggtattagtgcgggaggcgggtaaatctaagacacacccatggggtgagtgttattcccgcgcaaaaaatgtaaaaaaagccaaaaaaaaccttgctttaacactcgcatctctcccgctcaccccacaagtgctccgaccgtcgaaaagcacgttcgtgatatagcgctgcaatgcaatgcggtgtgatgccatacgcactgccctaccctgccactaccctgccctaacctttcctgccctgcatctttgccccgaacagcctgtgcctcgagccactaagctttactagacgaagcttattctcgagcacctcgagcggtgttccgtttgagacaacgggaaacatcaagacggcgagaaggagaacaatctggtctgactctaatcaagaacggcacaagtggcacccagggtacccacaattgacgatgtctttatgtcaaccagatttagcaatgaaataaccgttttgaccaggaccgcccgtcaacaatttagctttagctcttttttttttttttttttttttttttttggctttagcgtgcgccctgtccccataccctgctcggcccccgttctgtggtaccaaaacgtctgctgtgtgccccaggcgtgaaatgatgctcttcttcctgattaaattaattatagcaggacggttctccacagtgccacggctggctgggtcctttttttttcagtaaaccctccagctgccatctggttcacaacaggactgggatccgcaactgccccgatggatatgatgagacccggaagcccgcacagcacgctaattggtgtatgcaatcacactcactccttgtcctttgctgctttcacccatgacaatccaatagcattaagcaaaaaaacttgtgccacccacagagagtgaagaaatgaagggaaacgttgaaaagaaggaaagaaaatgctcagttgtgctcttgcactctcgctctctaccactctttcctcgctttctctcgcataaaaaattataggccagactatacttctggctcccgattggacactatcggcagctggctctctgttttgctttcgctatcgttactcttttgaagcattgaaccagacatggatcttctatccgagaagcgagtgcgaggtcgagagaacggcttcgtcgcttatcacttgacacaccacacatatttcgtgccgctgactccgtcgtcattcgaacgacgcttgaacaatgaaaaaaaaaccagggataaagggcaaggaacgtaaacgcacgcacacacatacgagccacaaaaaaaaaggatccttttcagggccaacattgcacacgggttgaccacaacgtaaaaaaaagaaaaaagcctgaccgtgatgcgtgcagggttacaaagcaagagtgggtcgaggttgagatagaatgtcgctgtgtctcgcagtcaagaagacttaagctgctgcgagccgatgtgggaaggtggatggatgaaaggtgcgtggcgatcggttagatcagaagagatacgtactgatggccttgaggtaagcttgtgaggcatcgctgactttgtcgagtgctacccgcttggcgtccgtctcgttcgtcaagctatgaaagtcctcgtccatgcgcgccttaggccctttgcctatcttctctccagtccactgtaagcaaccagaacaaaacagcgggttactacctcagctcagttcttttttatgctctcgagcgcttgcatacacagtagcatagcataagcaaagttgctaaagaccctgcaaagaaaaagccatggagctcgattccttcgagccctcatgtcatgtaaagtcatcacagcgttgttgaagagcagtttgcggttgacctgtcacgatggttggggctggcgctgtctcctgggttgctttccctttgaatgattccgtgtgcgcgtccggctgcatatcgtatgtcccagaaagaagtgaaaagcagggggcgctcggcgatactatgctgaggagtgccagacgggaaggtgggtagagagagagtctcgaagagcgagggaaggtgaggcgtacctgcttgaacttgccaatgttcttaatcatggtgcgcggtgctgggatggggcctaggcagaagtgaaaggaagggaaggagcggaagagacagaaagggaggggaagggaaggatggagacaaagagagaacgatgggaaggatgtaacgctggaatgcagagacaagaggtgaaattgcaaaaagtcggtcgggcaaagtgcttttgagtttgaacgtggagcagagccaaatttacacaactggcgtggggtgcgggcggtgattatgtcttttcaaaatagaatagaaaaactattttggcgggaggacacaaacgaccaagacagcggtggatgatgatgacaagagcgagagatggcgtgtgaatgcagcaccatgcagaccagagagagagcgaccggaacgagagacgagcgaaaaggtcggcaagaatggtcgtgcgatgtggatggggacagaacagcgcagaggaagacgaaaaagaagcttatttgtgtttgccatgatgaccaccttagagctcgccatgggcctcgtctcgctgtcctctcgctatcctcgcgctcatttctccttcccctcctcgtccttctttagcacgcacctccctcccatcttaattttcacacctgtctgtccgtgtgtcccttgccgcccgtcgcacagtcgtcagcgactcactgcctcctcaagtgtctcggagtggaaccatatgaattttttacatttctcgcatacgacccaacggtgcatgtgccaaaacacacacactccacaagagcatgctgacaaagacagtgaagtaagcatcagttatttttatgtatggtgttcaaatagagtgggcgggtggtgagggtggaatgggcagccagtattccagggaaggcgatcggtaacagaactgaagaaaacgaatgaatggactgtatataaacacttagcaggcgcagccgctcttatcctgctgtccaccgagccgctgaccgttgcctcccgcttgaagatccactcggccgttgctgccacctgctccagcacgtgcgccacgagtggaagacagaatatgctccagaggaatctttttagcgatctctgtgaacacctcggcgacacccttgccgttcttcgcggaagtctcaaagaacaaaaggccggactcttgtgcgtatgcgcttgcctcctcagtggggacttgacggctgactccataatcttcgtcgtcatcctcgtcctcatccagctcctgcgcatcgctttcctcgtcttcctctccctcaccatcgctagtgttcctctgtccacgtcgctctgatacaagatcgaccttgtttccagtcaatgcaatcacaatattgggattggcctgtcgctgaagctccttaacccaagactttgccttttccaaggatgactaagtttgcaacaacaaacgattgttagtcttttgatccacgctgacaataaatttctcaatgacataacgaacgactgatggaatatcttaccgctttggtgacatcgtatacaacgacggcggcctgggcgtttctgtaatacatcggcgccaaagagtggaagcgctcctgtccagctgatacattgttcaagaaatatatagcatataagctcactgatagaccggtagtcgttcgatggcaccgttcaaggcaacagccacatgaagatggcaataaaacatacctgtgtcccagatctcaaatttaatgaccttgtcctcgaggcggcacttttgagtaagaaaggcagctattcaccaacagtagcaagagaaagaaaagaaaacaaggatgaattactgcaatgacagaggcgagcctaagacgatcctgtcctttgtgcccaaccgtttacctccaatggtcggctccttgttctcctggaactcgtcattcacaaagcgaagcacaagacttgattttccgacagcggcctcacctagacataaaaaaagtgggaagcagagcgacaaaggttaacatacagtcatgtagggaaagctgtgaagggagacatgacgaagccataccacgccattcccaataaccccaggccgtccatgactcgttgtgtacgtatcgctgttgtatcgttgcatcgctgttgctttcaccagttgcgcttcctcgttcactcaaggacggacggccaccatccgcttgcccacgtcgcacccccacgaggctcccttttgtcttatgatcacttgcacccactcctgcagatatcagcctcctaattaagagggtgacagcgcgcaaagcaccaccctgatatcaaaagcggtcggcgttccataccccaactttctcggggctacagtggtcatattcatacgctccaagagcagccgtggtggtgcaacccctgtgtattcgtggcaccacgctgctgttgttttcaaatagtttttaggcgggaatgagggctgttgacagaaaaatattcttcaagtaccagcccatggcggtaaaagaatccgtaaaagcgaggaagcagcgtgcgaccccgagagacaagaatcaatgccacgcagtgcaacgtcgaaggatcgacgagtaaataaagtaaacggctgtagcagaatgggacagaacacaatatcctcactcttgccagtgaggccaaaaaaaaaagaacgaaaagccaagcacatactcaaaaaaaaaaaaaaagaaaaaagaaaaaggctccatgtgcccgctgagaaaatatggcgtgtaagaggtgctcgtatttgactggttgcaaggacctttagacagctgcgacaggtccagaagaagagaaatgcgtcccttgtaagaacgaaagatgaattaccaaggaggacgagcttgacttggacaggcttcatgttgctggcagcatggccggcggcgtcactggcttgggacatgttgagtgaaaatgtgcagtgtagtgtgtggagaatgcgcttcaagataaactggagcttgctgatcggctggatggagtgtgtgtgttttggagagtatgggtgttgcggtgcgctgcgtggttttctgtggtgtatgaagctgaagggtgaagaagggaaggtgaaagagcacaaaaagcgagagggcgtggtcgactatgacgatgcgtctatctgtaattgcacaatctataaatgcacacgtatgttagaagcacgttgctgaaagctcaaaacggacgttttgtcctgtccattcgatcttttgtaccatcgtcgagctgcaccaagacgcccaagtagtttgccgctatcaggaaatacctcgggacaccataatgtcgtcctccagctccaacaccatggagatcgaatccagcgagtacgaagcgcacatgcagtcgagaactcttgttgtcatggcgtcatgaagactgttcactcacgtctcttcttgcctccgaatctaacttagtgtcattcgactcattcagcagtttctaaaagaaaataacctcctcaactccctggctgcactccaggtaatttttttgtggccctgccatggtacacgatcgatgaacgactcggatctgacaggaagctctgcccgtatcatttcgatctgcggtgttaggaggagacgaccgttgcgttgaacacagtcgagagcatcgaggcattttcgtccgagatattgcaagggaactgggataatgtgttgagaatcgtatcacagctcaagatttccgagaagaagctcatggatctctatgaacaggtcagagacctttggatctaggatggatgatactgcttgccaccactgtatgagtgtactgatacacttggctgctaaacgacatagattgtgatcgagctggtagaacttcgcgagataggaactgcacgaacactcttacgccaaaccaccccgactcaactgctcagggatcagttcccggatcgatatctgcatttggagcacgtcctctcgcggtcgcactttgatgcaaaagaagcctacccaaacggagtatccaaggagaagaggaggcagatcattgcacaggcattgtcgagcgaagtaacggttgtagctccatcaaggctcttgaccctactagggcagtcgttaaagtttcaggaacagcagggtatgcttccacccgactcagcctatgatcttttcagaggcaccgtaccagtggttcaagcagagacggatgatgtcccgacaaagtgctacaacaccatcaaggtaaagcttgtaaaaggttctggctagcagtacgtaagacagcgtgggatcacatcgctaacatgtcctacaaaatacgaccgtgcaaacggattagttccccaagaagcagcatgcagaatgcgttgcattctcaccgaatgggcaataccttgtaacaggcagcatggatgggttcatcgaaatctggaactatcttacagcgaagctacgcaaggacctcatataccaagctgaggtaggtcgcttatacacgcatcaggggtcaaagtcatttagatacgtttttcttacagtacatcctctgcgccaccgtgttataggataacttgatggcaatggagtcggcagttctctgcttggggttcagtaaagacagcgaaatgctggcatcaggagcacaggacggaaagatcaaagtatggagaatccaaacagggcagtgcctccgtcgttattcccctgcgcatcaggcaggagtgacctctgtctgcttctcgcccgacggaactcaggtcctaagcgcctcttttgacctcaccgttcggtaagtgtagcgaggctcgatctgatcagaacatcccgtttcattttatgatatcatactgatttgactacatcgcatgcgctgacatcctcacaggcttcacggcttgaaatcgggcaagatgcttcgcgaattcagaggccatacgtcgtttgtaaaccacgcctccttttcgcttgacgggacgcaggttatgagctcaagctcggacggcacaatcaaggtaggagcgaactggcccccttcgacctgattaccaaagccgcgctgttgtggtttcccaactgaccttctgtttacctgggatgttcctcatgcttcagatttgggattacaagacagccaactgcttacggtcattctctccgcacgacggcacaggaaccatggctggagcagctggtctgacggtcaattcttgcatccctttccccaaacccaatcaaatcctggtttgcatgaagtcacccacggcctatctgctgacgatggagggtgaggccattcgcaagtttctctcacctgagagctcaactgagggtgggatcaaggatgcgggagcagcagcagcagcaagagccgcgggagcaggagaggaggccaggaaggagggactgggcgtgcccttgacggattacatggctgtcagcctttcaccgcagtctgagattgtgtactgtcttgcagagaacagccaagtgcattgcttccatgccgacagcgggaagctgatcaagtcgatcccagtagcggagggagaggtcattggtatggttgcacacccctcaacgaatgttctggctgtgaacacggtcgatggacgcgtccttttgtggaaggcatagaatctttctccagacctaaaaataatacacggcaggttggcggagatgacttttgagaaggtaggccagggtatcagttttgcctaggagggcgccatggtctgtgacgcgacgtttgctcctttgtttgttgtttgggctactctgcggctcggttcgccgtgtgaaagcttgttgccagcaccttggatttatctgatagatgtccaagtagagacgtcggcgcttgtaaacggcgaacatcatcccactttttctttcccttggggacttttttttctttctttctttctttctttcctctgttctcgtcactcttgtccctgaaggtttacgcctacgctacccttggcttcagacgtgccgtgagaagtgcccaaggtgtctatgtggatcaaggggaggagcactcgcgaatgatgccagtgcaagaagagtcttggtcgaggtgagtgccctcacaggcacacatcccaagcgcgagtatgcacagacggaggcatgttcacggtgttcgagaacacagcaaggacgcgtccatgcaccctggaacgagcatatgacaattgtgcgactggacaatcaactctacccgaagtcaaaaaatcaggccacccttggccccctgcaaaacctgtttgtggcagagcgttcaaatacgcataaaacgactcgatcccgccttccttctctgcctcgaccctgtctctgtctctcgctctttctctctcgctctttctcgctcgttcagtctctgcctcttcgcacctgctcgacagcatctgcactctcacaatcaaaggtcgctgcccaggatttgccctggttcgatacccacaacgccccacctcccatctccactctgcattccccatctcaaccctccactctctctcctgtcgacatgaccggcacaatcagcagccgcaccgcccaccacccgacagacaggacccgctggcgcttgcgggtcaacgagggaaggcagacctggcactatgtcagcgaagaggagagtcgtactcatcctcagaccgacattgaaaagtactggcttgacctcaagatggtaagagaaggaaaaaaatgcggtgcagggctcgattcgagcacacagatttttatattaacaatggtccccctcactgtccgtccactattgcagagcccttccacccttcccaagccaacgacagcgctcgaggcggccaggaacggcttcgagttttttaagcgacttcagaacgaggagggattctggtctggagaatatggcggacccatgttccttctgccaggactggtcatcacgtactatgttactggagtcaaattacccgagggctggtcggacgagatcatcctgtacttgttcaacagggcgcacgcggatgatggtggatggggcctgtaagtggcaacgaacggaggatggagcttgtctctttgtgcatgtctggatctgtagaatccactcgctcacattctattattcaactttttatttcatatgatcccataggcacatcgagggacactcgacagtgtttggaaccgcattgaactacatcgtcctccgtttactgggtgtggatgccgagcatccggtctgtgtcagagcgcgtgggactctgcataaactaggtaaactccctttgtgagagtgaccaggcgatgatcacagcgatcttgatctgtgaaccttgggctaacaagctcgaactgtcctgtcaatgtaggcggcgctacgggatcgccctcgtggggtaaattctggatggcggcgttgggtgtgtacgactgggacggcatgaaccctgtgcccccagagctgtggctcctcccccatttcctaccgatccacccagctcggtactggtgccacactcgcaacgtgtacattcccatgagttacatctatggtcgtaaagccaccccagctttgactccgctcacgagacagttgcgtgaggagctttacacgcagccttacgacaccattctctggtatcagcagcgcaacaacatctgcaaggcggacgaatactacccccacactcgtcttctcaactttttgaacggaggtctggtcattgcagagaagggaatctcaaagacaggaatcagaactcgggccttgaaggctgcctatgcgcaggtcaaatacgaggacgaaaacactcattacctggatattggccctgtcaacaagatgatgaacatgttgtcgaccttttatgaggagggcaaggactctgaggctttcaagctgcatgtcaagaacaacattgactttatgtggtacgtgcccttgatcagagatcaaggattgctactcatgattgcgatctacaaagcttgagcatctcgacaaaaacactcacatatcgttttttctttattgatctataggatgtctggtggaggaatgatgatgaacggcaccaacggatcacagctttgggatactgcattgctgatccagggagtcattgagtcaggattggctgaggagccccagaaccatgaagcgatgaaacgtggactgatgttcttggatgattgccagatcaagcggaaccctccgttcatgaaggaaggctttcgcgatgcgaccttgggtgcttggcccttcagcaacaagtttcagggctacacagtctctgactgcacgtctgagggtctcaaggctgtcctgctccttcaaggaaaactcaggtatatgccgctgtttccggagtgctctcaggagggttgtggaacagcgatatatgtgggcactttgcagtttattctgaccagcattgactttttcactttttagctataccacggagcaagtttcgatgcaacgtctggagcaagcagtggatattgtcttgggaatgcagaacaagagcggaggatttgcctcatacgagagcgtgcgaggtcccgcgtggttggaatggatcaaccctgcagaggtgtttggtaacattatgattgaatactgctaccctgaatgctcgacagcgtgtgttctcggattgacctacttccgggaacagcggcctgactaccgaagcgaggaaattgagtaagcttctccttgagagacacatttgccctcttgtactgctctaccacttggaccccatatttttttggtttcattctctcacatcaacgattgcttgtctattagtgtcacgatcgaacgcgctgtcaagtttattttgagcgttcagagagaggatggatcgtggtatggatcctgggccatctgcttcacgtacgccaccttgtttgcactcgagagtttgagcagcgtcggacaatcctacagcaacaggtacgagattctggaacgcgctagaaaaaaaacaggcgggaaaagccttgacttgttgatacagatcaagagagctaaagtattcgtcgcattcatctttctttttagtgagccggttaggaaagcatgcgagttcctgttgtcgaagcaacgtgtggatggtggatggggcgagtcctacaagtcgtgtgaacaacacgtgtacgtcgagcacgagaactctcaggtggtccagaccgcctgggcattgcttgcgctgatggcggccaagtgcccgaaccagaaggcgatccagcgcggtgttgagctgatcatgtcgagacagctgcccgatggacagtggaagcaggaggccattgagggtatctttaaccactcgtgctccatctcgtatcccaactacaagcacatctttgccatttgggccctgggacggtacgcaaaaacctatggcgatgctctttagaaaaatacaaaccatttgtttctgaagagtctatcgtccagctgcttttgggagagaccgttttcacaagtgatggcgcgcggatggaatgcgctctctggtgaaaagtgtccggggaaaggaaagactcgatctttgcgcgaccgtgatgtgagtttttgtgctcatatttccttggatgttttccgacgactatatgcatggaaatattcagctgtctcaacatgctggcacgagcttcttcatgaacgtccgttgagcgctttgcaaacacttctcgttgcgaaaaagttgccgaaaaagttgccgaagaagcttgtgatggctgattttggcgatccatgtacagaagtctctctctcgtacgttcacaacatttgctgatcggtggtccttttgtttttgttctgttctttttgtgttgtttatatacattacgttgctgttcctttcttttgtgctggcgcctagtgtctagaaaaaaaacgtttttctgagtctgcccggtgtccgctctgtttccttggtctgtcttctttttgcggtgattgcctagtatcctgcgaccctgctcagaggttcttccaagtgtcgagtcaacgcctctgactttgccttcagtatgcccagttcaacatcatcccgtgccaccagacacaggatcattgtgctgacgatggtgatcgccaccttgccctcctaaagtcaaaaagaaatagttgtggacatggttaaaacggaagttcagaatgagacgcgagtcagtcgcaaggaaatggaagccaaatttggttttcaaagataggctcctgtttaaagaagaagccaatgtgtgtgtgtgtgtgtgtgtgtgtatgtgtgcgtgtatgtgtgcgtatgcaagtggtccgtgagagctggcgagcgagaaaaagggtaaggtacctcacagtccaggatcaggaacgacaggggtccgacctcgggcttgcagtgttttgaatagatggtccagatgttggatgcgatcgcgccatagatgcgtgcgtcccgatcagattgagctgcgaaggcgagcagtgacccttcagggtttagcaatctatagagagatggatggagaaggcacaaaaaaatcaagtgcggtgcgattagcactttgcgccatgaacgcttggtgtgtccatgcgagtgggtgtgtgccccgtgctgttcttcctgtgtagggatgcgttacatggtcgccttgacgcctccagtggtggcctgctgcagcacctgcgagatgagttttggcttgagcattgtgtctggatgtctggcttatcagagtcgcttgagagggatgcgcgcaaaaaagaacgaaacagaagagggcggttccttcaattcaatcaacctccttggcgtcgtggtcgatggcggatgtggtggatgtgggcaagattcaacagatttgagggagagctgatggagaaggggctcccaactcgagaagtcacaaggatgcgcttgcgaatattcgtagacgcgtgagtactagcaaaattgtaggccatgcggctaggcaacatcggatagggtcgcaaagaggtagacgtgccgcctaggtagtgattacgcatgtatgagcaaaggcaagctgggagccaccgatcaagaggggtcctccaggcgcatcctgtacatgactagatcttttcaaggcgaatagaggcgacttgccctggcttaggtgcggctagctcctgccctttgtctgatatatcatgcataccatgactgagttcaaggtcagcatatgaccccaagattgggaaacgctgcatgtgcgcgcatatcatgtatatacatacatgtagttgccgcttattcacctgcctgatgatcggatggcataaatatggcccttgttgttggtgctcaagctttcccatctgtcatgtcttggtgtgtgtcgcgaaaaaaaaggtgcgctacagggttgcgcgataggggaggtgacaggagcaaaaacaagggattgcttttttccaagacagcaacagcccggtctctcgttacccctatgttcgaccacactcctcatcagtcgtgtcgagaaagtccgctattcatccgaagaatcgaacgagcgcaaggaccaatagctaaacccagggcggaaaagaaaaggggatcacggcggattctcgaagaggaagctttggaaggttcattgtcttctgagcgaatttttcctctttgtcattcgtttccaatgctcggcttctagatattgcacagtgcggcgatcacatcgtgctgctcctggccgagtgcatggatcattcgagagagccgtttttcatgaccctctgtcctcttcagcaaacctcaggagaaacctttgtgaacgactttatgacacactgtttgcgactgctacacagtgcgcgacagaggtgctttgccttctgaagcttccacgactgctgtcgttaaagtcgaccctctcttttcccatccctccgtggcagagtcattaaagcaataatcgatcgcatgctgtcatcagcccacaatttcacttgatgtatgagcacatcgattcactctgaagcgtggcggttcgttcatgagcaagtgggatgaaaatagcccgcgcgttgaccaaggatatgagattggtaaatggcatcaagttctaattaaaggacagcgctcagcaggatacaaagagcagctattgcctgccacgaggtgaaagaaaaaaaagaataaaaaagccattttgaatcatattttggacttttgggcatctgggcagattttgaagtggccgctgagcctcctctgcgcaaagaatgttcgatccacaagcagcgacagttgaaagcacgaggttgatttcatctcagggtgcagcgaatcacagccccactccctccacgttcagctatcagtcgacagaacgcactcgcgaaactatatgtgatggccacacatctcgtacaccatcaagggacgctcctcgcttgcatactgtagaaattcaaatccccggtaacttgcacaacaaagcaagatttgtactccttggatcgaatcattggaagatgaccgttcacgaccattattgctctcggccaccctttgccccctgttggcccgggtcgaggcctcaggtcagcgtccaaaaatacgtcacctgcaacaccctagtagaaaagtgattcaggtgggcctggctactcagcctggctacagcagcaagcacctttgcaatgagctgtaccggcagtgagtgattcccgtgagatgcagtgggcacacacataggatgccgaccgtggtcctgccataaacgttgatgctcagaaggaactgcaagaggtgcgtgcaagtacaagttcggtagtacacacgcaggtccagccatgggcagatagacttccgctgcaacggatgcgccgatgaccagccagtgacctgctctcatggccctggatatatcagtgaggacaaggcccaaaccctgtttagcagcaggttatttttcatgtacccgtagaaattcgaaggttccgacgcttctattctcatcctcctgttgcgcttcgcttgtcgcacacacgcacacacaccactggcacattcactcactgtttttcgcaggcatggctcatcatccagttagtctcggtcattgacagttcaactcccaaaatggcaccctttgcaagcgggatggttcgtccatccacctctgtttttttttaacctctgtcatgatttgctcgggctatcatttcttttcattcttttttgccagtaggacttgtggtctgaaactactgagcaggaggcaaagagactttgatggatagggatagagatggggagcagcaacaatccaaggaaatccagcccgaaaaaaaagatatgctcggctcccccctggtgttgtgtccccccccaatggcagcgcgtggtgttttcccaccttgttgtgcccagtgtccatggtggcagctgtgtggccaatgagaggccgcagccaggcttagaatatcgaatatacagactaccacactgttgcgatagagtagtctagtgtggaagagatttatttaatggaccagctagagctcattgagttcatgacgagaagaataaaaaaaaaaaaaaagctcgccttttgccccctcgattttctcgatttcttcgaattctggcatggaattctatttgagcgcatcacccgcacgctcgctctcgttctcttctgtagttcaaactgccgcttgcagcccagcagagtgatcgcggctgggatggaccctagcggggcgacagaggcccttcttttgttctattgttcgcccttcctgcgcttccatcagcaccttgggtccccttattcaatctgctctactcctccgccttgccgcgtcccctgcatcaccacaactgtgtgccgcgtctctgggccacacacggttgatatataacctggcatcatcatccccaaaccgtgatcctcttttttgttctctctcgctctttcctcttctcctcctttgttccccactccttacctccaccgtaacgatactccatttttttttattttcttttgctatcgttactgttgcccttgcctcccactctcactctctcgctctctctcgccctcgcccttccttcccgtcgccgcgcaaacccacctccgaggggcccaactccagaactactgcaccctcttccatccccatcccttttctccgcttccacctcccccttccattttaacatagacgctcagtctcttttaaacagcacacccttggtgtcattcatataaaccatggacaaggccgaactggactcgtcgcagtccgagattcaggccactcaaccagccgacaaccaccccagcacccactctgaatcctcagcaacctccacctccgctacgcctcagtatgcatccaccactgtagcgaccgtggctgatccccgccccaccaacaacggccccttctccttcaccccagatgagcttatggacctcatcgacccaaagtcgccagagacgctcgaagcttatggcggtattcagggcgtgttggccggtctgcatgctgatcccgtcaagggcctcgcaacccacaaccagcccctagccactgtcacctctggcgagagcgagaaggccgagtcctcctctgctgcacatggcaaatccaccgggcctgtgtcgttcgaggatcgcatccagtactttggccgcaatgtgctgcccaagcgcaagcctaagagcatctttcagctcatgtggatggctcttcaggaaaagattctggtgagtttttatttagctctgctctgtttctaccactcttcttttggccggtgaaaccaccaccatttccctcctcgatacaacctgtgtgcgaagtgtatcaaaggatgaagtgaggacaaaatacaaaagagagttcaccgcacctgaaagcgcaaggtacacaggccccgcgtccgccctgtctcggtatagaactgagactggcgaggaatagccggcaaactcagccccaaaacacagaacacccaatctccagtcgctggaaatagcaccttgggactggacgcggagcttgtgtgcgcatgtagattggctacctcaaccgttccttctgcgccgactcagtcgtttggatggcacacttgtacattccgagcaggctcactaacacctcagctctgtcatccgccatgatatcatgccatgtagattcttcttttgatcgctgctgtcgtctccgttggcctgggtctctatgaggactttggcatgaagcacgaggaaaagatcatctacgataggaacttcaatgcctctgtccgcgagaaccccaagatcgcctgggtcgagggtgttgctatcctggttgctgtcatgattgtcgtcttggtcggttccatcaatgatttccagaaggagaagcagttccgcaagctgaatgccaagaaggaggaccgcgaggtcaaggtccttcgcaacggcgagactgttctgctctcggtctttgatatcattgtcggtgacattctgcacctcgagcctggtgatgtgatctctgcggatggtatcttcctcggcggacacaacctcaagtgcgacgaatcggccatgacaggagagtcggatgccgtcaagaaggtttcctacgacgaatacaaccgcatgctcgagcacgaaaccgctctgcacgccaaggatggcagcgataccccttttgatccccaccatgccctccacggtgtcgatcctttcatcatctctggctccaaggtcttggagggtgtcggtctctatgctgtcaccggtgttggcgagaacagcttccacggcaagactatgatgtcgctccgcaccgaacccgaggacactcccttgcaggccaagctgaacggtctggcggagcagattgccaagctcggtacattagctgctgtactcatgctggttgttctcttcatccgttacttcgtcgggttcaaggatcgtgttcccgcgtccaacgaaattgtatcgaacgttgtccaaatcatcatttccgctgttaccgttatcgtcgttgccgtgcccgagggtctgccgcttgccgtcactctggccttggcctttgccaccactcgcatgttgaaggacaacaacttggtccgtgtgctcgctgcttgcgagaccatgggtaacgctacgaccatttgctctgataagactggaaccttgacccagaatcggtatgtttacctcatctgtatgcagtgaatgtctttttttttgcaagttttgttgccttttgctcaccatggctcctgctttccttcatattagcatgaccattgtcgctggaactttgggactcaacactcgcttcattgccgatgcggccgagggcgattccaaccagcgcgccgccatccccatcaacaagcatgccgtccctatgagccaactcgtcagcaacatccctggttccgtgaccaagctgatgcatgaggccatcgccatcaactcgtcggcctttgaaagcgaggatgagaagggcaacctttcgttcatcggttccaagactgaggttgctatgcttgatttctcaaagaagattggtggtgccgactaccgtgtcctccgcgaggcttctcctgttgtccacttgtaccccttctcgtctgagcgcaagtctatggccaccattgtgcagatgggtcccaaaaagttccgtctccacgccaagggtgcttccgagatcatcatgaaacgttgcgacaaggttctccagatttcgtccggcgaggatgcccccctctccgagaaggagcgcgatgctgatgtcaccgaactggcccttaacgatgagctcgagacccatatccacaagaccatcatttcatacgctactcagtccctccgtaccattggtgtcgcctaccgtgatttcgagtcctggcccccagctggcgttgagctgaacgccgatggagaggttcccttctctgctgttgccgagagcggcatgacctttattggagttgtcggtattgaggatcctcttcgtgacggagtccccgacgccgtccttgcctgccagcgtgctggtgtctttgttcgtatggtgaccggtgacaatatcttgaccgcaaagtccattgcaacccaatgtggaatctacacccagggaggcatcatcatggagggacccaagttccgtgccttgagtggcgaggagatggatgcagtcattccccgcctccaggtcttggcccgctctagtcccgaggacaagaagattcttgtcggtcgtctcaaggccatgggtgagattgttgcggtgactggtgatggtaccaacgacggacccgctctcaagatgtccgatgttggtttctcgatgggtatcgccggaacagaggttgctaaggaagcctcgtcgatcattctcatggacgacaacttctcgagcattgtcaaggccattctctggggacgctctgtcaacgatgctgtcaagaagttcttgcagttccagcttaccgtcaacgtcactgctgtcatcctgacctttgtcaccgctgttgcctctgagaaacaggagcctgtcatgtcagcggtccagctgttgtgggtcaacttgatcatggatactcttgccgcccttgctcttgccacggaccccccaaccctggatcttttggaccgccagccagaaccacgcactgctcccttgatctcgttcacgatgtggaagatgattctcggccaggccatcctgcagctagtcatcacttttactctggagtatgctggagtggaaattctcaactacaacgagattcccgcctcgcttgcaaccaaagtcgctgtcatcacgcccgaaattgaagctgcttacagaaccttcaagagccaggagctcaagaccatggtcttcaacacgtttgtgttcctccagatctttaacgaggtcaactgccgtcgtctggataaccgcctcaacatctttgcgggcattcagaacaacagatacttcatggtcatttttgtgatcatggttgttttccagatcctcatcgtggagtttggcggtgctgcttttgagaccgagaagttgagtgctacccagtggttgatctgcgtgctgttgggtcttctctccctccctgcaggtgtccttatccgcttgatccccgacgcagcctttggcagcctcaagaactgggtcaacaatggcgatggctccacgagcggtgctctccccaactttgagagcttccctgattcaaacgagcctggccgcgtcaactccatccctgcctccgttggatccaaccgcgccaactcgattgctggcagtggcaacaacgtgtaccccagccgcgacggccttgtttggaacccagccatcaccaaggtgcgctctgacctgtctctcttcaagtcgatccgcggtggtcgtctctcgacggactctgataggagtggacatgctgttcatgccgccgccatggtccccaccttggtggcgacatctgtcggcgcaggatggtctccaagaggccgcaacacgcccggtaactcgtcgagccaggtggacgttagtaactcgagcccacggaccagtgtcgttggatcgcgccgtggcacgggccatagcagcatccgtcctgcgacgccccagggcacctcttctgcgcctgtaaataccaccaccaccaccaccaccactaccaacaccaccggcagtgccgcaccccccacgtactctccatgatctacctttacgaatacgtagcacattttgacatctatacaataataccgaaaatcgcattgtgccccatgaataaaactcatttaatggtatctttgtgaccgagctcggcatgttctcgtgctctttttttctccttatcaattcctacagaacgataaaacgacagcttgagtcgcgttgtgccaacaactgccaaggcgcggatgtggctttgccatacatgagccaaaaaaatcataaacgcgtctcaactttggcaccctcctttccacgcgccagttgattctattgacgactattcttcattgctgcccccattgcacctcgcctccgtctcatccttcctcccactcttccctccctccggtccttcctccttcgtagacgttcactacagcaacatgccccaggatgcgccacatcaccgccgcaagtcaaggattggccctggcatgcttctcacgcggtcagtcggccaagggggtgcatcagcggcaacagctacagcaacagccacaacagcagtagggcgaccctcggaaggtaacccttcgctcttcagcacgttacgacagcaggacgacgaggccaactcattacggcgctcgcagcattaccacccattgaacgcatccctggggcctaagccagatcttgaccatgacctcccagtcgttttggctcagtgcagaccgatctcgctggaggtgggcgatcctctggatcagctctgcatggccgtggataagctcgtggatacgatggcggtcgtggcagacatccatgctggtctggcgcagtttaacgaatcgtttggttcgtttctttacggccttaagatgaatggcgcaaacgtggaatggacagaggtacatccgttgttggctgttggccgatcgcagacttgttctaggatacaatacactgcgcgttgcaatcatctattgacaggcactttcaaacgtgcttttccttctcaactacgaaaactaggcaccgacaaagcagtcgtttgagagacaggagcagcgtgaggcagaggcgatactactgcaacaacagcaggaggaactggagcgcattcgacatcagcacttgcttgagcaggagcaggaagagcggcggcgtcttgaggaggaggagaggcatgaggctgaacgggtgaaggcttcgctggcgatgcttcggagcagcgggaataatagcaacagcaatactcatggtaattatccaaagcgaacaggcatccctgttgtgtccaaaggacgaggcatggcaggtacatcaaggattccggcagcgaggaacaacggagcccgaccagccgggtctgcatctggagcttccagagtgggacccggaggcgcggtgcggaaacttgcaggcaagatggtgatgaagcgtgtcgctgaccgactgccgctcaaataccgagacgaggtaaaggaagccatgcattcgtgcacggtgatagctgcatggcttgcaagatgggacagcactgacatgcccttttctaatatgctttgtattctggacactgcgatggatagccacatcgagcgccgattgaagccattatgcggtccctggccgaccacatcgaggggcaatatctgccggacctggtggccgtggcgggagtggcgcgacaccgatgcaacgagtatctgggggtgttgatccatgccaaggaggtgattaagacgagcaacaagggtgtgttgttctcattgaaccccgaccggtatccaagtcggtagacgcagcccttcctttctctttttgtattttgccgccctttttagttaccaacccccccccccgcctgcccgcagcaccggcttgtattttatgagtttagaacacgaagaacaagaggaacaaaatgaagtgaaaaggaacaacaggaaacaccattttcgtgcagcgctggtgtgttcaaagacgccaaaaccaggctgtggttgccttctgatggctgttgtgtgtgtgtgtgtgtgtgtgtgtgtgcgcctccttgtttgtcttccaaacattatcaacatctgcaccgtcaatccgaggaagaataaaagcttttgatttctattttcgctcttcacaccactttcgttctgcattcatcccttcgcgcttgccccattccttcagcccagcaaccctcaagaacagttccccgtcctcctgcctcttcctcgctctcctcgccctcctctcccttcatctccgcgtccctgggcgagtaggaaaaaaaaaagacccgaccatcgccctttccaccaacacagagctcgaggaaactcaaaaactttaccccccagcacaaagcgagtcaacagccagtgaaaggggcaacgacagcacaggaatctgaccatgcctcgacggcgccgactttgctgggatcggcaatgcctggccttgctcagtctcgttctcgttctccagctcctgtccctgcatggcctaagcgtcttagggacccacagtctcgtcctggctgccgccgtcccagcaatggcgagtgttgaagggagacagcctcctcactcctggaaaggtgtctctgcgacggttgagagctttctgccggaaggggcggcgggtcagcctcgggtcagcagtaccagcagcaacagcgagcgggggagtctaaataggcgtagcaaggatgaagttatcatcaccacgcttcgacgacgggaggtcgttcaggacattgtccaggacgcggacgactacgagcgactggcagacacgccgtccgtggacaactttttgcccaggggcagggccatcccgcaccgcgaatttccaacagcgaccacgctctgtgataccgattcgccgcagacgcttgggccaggctggaacggtacctttgcgagcaactcgcccgaaggcatgtacccgtcgcagaaccgcacctgcgtctggaccatgcacgctgccccaagtagttcgcgggacacaccttatgtgatccaggtcaacttttcaactcccatccaactgatgtgcgggtatgcaacacctgcggcgatgacaggaacatcatcagtaacagcagcaactttgccgacacttgcctaacactattcgaggccctctttcttctatccgcccccctacattgttgctgcatgcatataggacggactatctaacactctacgacgggcctgacacgacctcgccacgcatcgccgtgatctgtggccagatatggccgaacaacttgccaacattctattccacaggcccgcagctcaccgctgttttcacatcacaggaacggacccctggatcctttggcttcactgctgtctggacctctattggtaaaaataataatgcataccgtttcctttttttttgtttggaatcgggtaatgttttatgttctaataaagatctgtcgcttccccttttcggttatagctccttgctctgtctgttctgcatctggacgagggacttgcaccaacggaaacacctgtgcttgcaatagtggatacagcggggtcgtatgtgaagcaggtaattcgatagcagagcgcaaaaaagacagtagctcactatggcaaaagatgccatgaacaacagtgcgtactgctcatggatcaacagcgacaggcgcagtaagaaagaagaagaaggattaaccgcgtgctatcgcttttcagtcgccacagatttcaaagagtttgttgcccgctcacagcacgccatggcgtacgacgcagtcaaggatatcgtctacatcatgggcggaaccagcctgagaggctccatgttttgggacatgttgtcctaccactttggtaagcatcgtggacactgatcgcaaaaaatgactttccagcggcgcgctaatgtcacgaacttgtgctgatgcgatctttttctttctcctttctcgctttgttggctctctgttgacagggacaaacaaatggagcaaaattgaggcaggtccgaagaggcctcccagcccacgctatggccattttgcattcgtccataacagcgacgtttatgtctacggaggtatatcttccattggaggcattgctgacctctggaggtttaatgtcaccagcaaggcgtgggatcccttgcgggctatcaacgaagacaaactccctgagggacgtgctggatcagcctgtgtggtcgtgacaaccgacaactcgacaaagctatatgtctttggcggtctggattcaaaaggcgtgatgtcccgggacctcaactactatgatattggtatgtgcagcatgacctacagagcatagacacgcgttgttatcatgtactcacctcgtttctgatgtaattgttgggtctaggtcaggccatgtggagaaagtcggatcatccaaactcaatcgggttggcaggagcaaccggcgtttatcacaaggcaacggactcgatctattactttggaggcatggtcaacccaacgacacggaatgttgtcacctatcaatacaggatttctcaggacctttggtacgcacttgctccgcgggtggacccgttcacgacacatcccgcacgatactggagctcaagccagctcgaaccttcttcgccaggcaactctacagatgatgatactcgagcggatattgaccaggacagtgacgccgagatttctcaaaataccacagctcagtatctcccaccggtcatgtatgatcaggtttcggccgtttgggcgcctgcagcactcatgggcgacgactcggttgtgatgtttggcggcatgcgacctttcgggccaggattgaacgagcgggaccaatcctgtttcgtaaaagagttctccatctttgacctttgtacgttcccacgtcatgaagctacgctatgggaaattgctgggtattgtactcacgttcactttttgcctacccgcttagcctgtcagacatggaccacctatgcagcaccggagttgagttctttgcccaggggacgggcgaatcacaccatgattataaggccaccgggagctgcaggagggaaccaaacggcctggacggcgtacatctttggagggttcgatggcgttgaccacgcggacgtggttagtgtcactctggatattgcaccaagcatcccagtgagtgtcaacaattgccgaggtgaggcgcccttgctttgggagttgtggggtcagcgacatgcgaacgacaatgactgccgtgctcaacaagctgcctctttgattgtttgctgacgacgacgtttctgatgttgtgctattgacaatatgatagctctgcgctggtgtagtctttatgacgactgtccgaactgcaatctcagttattgctcgtacgtcaatggattgtgcttatttgacacggacaaggcaaagaattcagggaagcttgtgggtagtgctttggatacacccaagaccggcacggtccaggatttgcttcggcagcgacccgagctgcagaaagtccagtcaatcgaagggtgtcctgaaagagaatcgctggtcctgggcaacccttatgcgagcacgctcgatccggacaaggaaaagtcgttcatcatctacattgacgcacatgatctcaacattcgcttcgaggtcaggacgtacccttccatgatgctgagcttcaaaacactcaacgtctgggagggcttcatgaatatgtactggcgcgcggatcatgggctaacggatggttcctgggacgggtcttcatggacgtcatcgccgagaccgtcagatctcccggatccatgggacgatggtatttatgtaggagatggtcctgtcatctcgccggcgggatttctgaacacgagtgagctgatgaatcgatggacccaatactcaggactggacgcgagcgtgaggatgtcagctcttcgacgcaacacgtcctacatctacttcccggccaacgaccctcgacgattctcgggctactatgtgttttcgctcacgaaccacaaccccacgccgatatcgtattcgcttacggtcacgctgatggaccacccgacgcctgtggataaggccaagtcaacgccgttcaacatggccaccttggcgttttttatgctggggtttgtgttggcgatagcactgttggtgtttatggctcgcaagattcgacagctggtcgaggacagagatgcggcccatcgagcggcggaaatgcagatgcttgaggaggacgaggaacagaggaatcgcaacggacgtggaaacggtggcggcatgaacttgaatggagaggacggtagtctgttactcaggaaacccatgtacagggtggtgattggggtccaggacatggaacgaaacgccctaaatgggtactcgaacgcgcagctgaggcaacggatcattcgaggggatggacctgttttgaggccgaagcagaagaacggcatgatgaataacgtcatggagtcgcgtgatagaaaccagttgacgcgtcctggcgcgaacaatgaccctggacgaccagaggaaggtgcggcgattgcggattcgtcagagccgaatgctaagcactcgcgcgttcgttcggactacatccgggacattggatcggcacccctgctcctgccggactctatggatgcgatgacggacacggactgctcagaactgaacaggtctttttcgatgaacgactcgcgacggtcagcgtcctcggttcacgaccttggggctggcgcggcagttgcggcaatgtcacgacggggtgcacaatctgtgagcagacacgtcggtgacggaatccagcccgatattggcaagacgaaaaagtccgctgcggccacaacggcacaggagagtggcagtggagtgcatcgtggatggtctttgaagagtcttgggcggtcgggctctctcaggcgactccagagccattcatccaggatcagcccagaggagcggaggggcctaacaagtctggatgtgcccgaggagaatgagagcacgcatagccgaagcagcagtcgtagctgttatgatagtgaacaggaaattgtagatctccgtcgtttgacagcccagaccgacttgttgcaggctcgacaaggcgaactggaaaggtaccggcgacaggtcgaggaggaagaggcggcgggatggagggttggtcgtcgtaacccgatcaaggtccaacccatctcggtagaacccttgccgtttcaaacggggctggtccctcgtacgatggctcacctcaagcgatatcagcgtactcttgctaaacagcagcagcgacaggaactggaaaggcagcaacttgagcagggttcgaatgaaggcctgcgctcgtcaacatcgatccatgtaggcgcagaagccactcgcccaggcgagggtagtatgaggcgaggcggtgagatccatatgggctcgatgcgttcgacacgttccgcgcgaaggcggcctgcgctgggtcattcgccgtcgtcgtcgtcctctgtcacggcggctcaacggacgcccttgaggccggttcggccggtgcggtctcaggggtcgttgcatgagttacacaagaaggcgtctcgcatgacgcttcgaacgaacggcgagaccgtgtccaaggctgcggttgaatcccagccccagtcgcagactgaaccttggcgggttggaatggacgaggacgtggaagctggaattgagttgaggcagttggtcggttcaaggagcgtcgctgatcgacagcaacagcaacagcaacagcaacagcaacagcaacagcaggagcaaaagacgcagccacagcgacagcgagaggatcgaccagagtcaccacacgtgttggccttgaaggacgcgcctgccaagcgcaagccgatcaagatgaggggtcggcaagagtacgagccaggtccactgctggcgatgaatattctgattgtgtttccgggcgatgctggatcacgtaaggtgcgccaacaaggagacgcatggagggcagagacggccacggagggcgcgattgcggaaaaggtggaggagtcgaggatgaggtctgcgatgatggcgagtgatgataccctgtacagtactgaaaagcggcttcctccaatggccattggtacggtctttgtaccggaccctgtaaggtggtgggcctacaaggccaagctgcagctggatcggcggcggtttgagcggcagatgcgttggcggatgcttaagcatgagcaaaaacaacagcagccacagggcccacagcggcccttgccagccaagactcgttgacatgagagaaattcagtaataactgtgcaaaaaagagaatatcgagtgaaaaccgaggggagtttattaagcgagtactgaaaaaaaaaaaggaaacaaggtctttgaagattagaaggtgctgtacgccactccgttcgcatcgggaggatggccattgccctggacttgggtggtatgcgtcgcaggaggaggcgcgtatgactgatgaggctgttcctgtaatggatagtgtccaccatgtgcctcgggatcgtactcttgtttctggacgtgagttgcagtagttgtggtggcggccccggcgcctgcacccattgcagcagcagcagcagcagcggtgttgttgttgatcgccgggtggtactgctgctggttattgtcgtaatagccgtgtccgctgtcgcgcacggccgcgctgttgatgctggtcttgctgccggttttgctgccggcccggtggggcacgacggtggtctggctgacatagtcaatgttggtggagaggcgtgggggtttgctcttgagctggaacaactccataagcatcgccaccaaccacaacccgcccatgattccggcagcgatctcggcgccatagatcgctggttgacagttttcaagcgcgcgttgtgtgtggaagtgtaagtgtatggatgttgtgtgtgaggtcatttggacaaaatcacaaatcgaacaagaaaagaaggatagacggaaatgattggtgagcgcgtcattctgaggggatcaatcgcaagtctgacagcaaagtaacaaaggcaagcagcgaccattttttttcccttaccattgaagtttttggtcgtgcgacagttcggactattgtcccccaggatctgacatcctttgttcagtccgataccaatctcgccacagactgcaaaggagagtatggccagtgcgccagagagggcgaggaagaggaccgagatgcccttgggcgcgtactcgtccttgcggcggacaaacatgatccagagagccaagaagatgagcgccaagacggcggtgacggcgcaggcgacgatggggaagatgcagtatccgttgttgtagctgacgacgtcgttgtcgatgctcatgtagagcaggcagacgctgtcgagcgtgcgaagggtgattttgccgttgacgccgacgagacccatgatgatgacggagagaaggaagcagcaggcgaggcagacgatggtgacgatctgcctgacccttgcaccgcgagaggtcatttgtgcgtgtgtctgtgtgtgtgtgtgtgtgtgtgtgtgtttgtgtgtatgtgagtgtatgtaggtaaggtgcgctccttatgaatacttgtctgttgcgggaaaagaggaagggtgctggagggtctgagagtgagcaagagttgaaaagaggaaatagagaagtgggaggatgagaggcaaggtgatgggctaccagagagacgatcggttgaggcgggtatgccgattcgttcgaggcaaaaaaaaaataaaaaaaccacttgcggctgtctcacccggaaagatgattttttggtttttgaggatcgcgctcaggccacacgctacgccagacttttgatcgtcatcatggagtcagcgggttgtggcgcgtccagggttccaggatgaatggatgttgcgcgagcataagcgacagggttgcctgtttacagatcgatctgctgtgttgctcagctagccaagtccaacactgcgcgctcgctgcgtggtggtacgatggttgacaagggtccgtaacgcctcttcagtttttttcaccccacgcgatggtgagggaagctgcacgtgactttgtgtcgaaatgacctttttgtgcatgtccgttttcccgcgcactttccagtcgacgaccactcttcacattgtcctctgcacgcagacccatccactggcgctgcatctcacccagacagcggcacaaccatgccatcagcccgacacgtctccctcgtccaaaagctccgctggcacgtcagcgggaacatctccccgacagccttcgcgattggcgacatcgaaggccatggggtatgaattaggaattgcagcaccgctccaaaggatttcacctccgtctgtagacctgacctgacgtgaatttaactcggtcctatgtcgatgcatgctaggataatgcctttgtcattggcaacttggtcggcgaactttttatcttcaaaggaaaccacccggaggggttaccatggctgacatgcaagggacttggcacggtaaggcttcatgtcggcgcttcaaggatttcctttgcagccggcgcgaacgcactatgtcttcgagtccagctggctgacccgtgcatgttcatcccccacagattaccgcggtcgcgatcggcgatatcaggaactggggcaaaaactcgatcgtcgtcttgagcgcggaaggattgtgccatatctttgacgttgcaggattagacgacgagaacagccataccacctcttcggggatggccatgccgccagcatcaaaatcagcatcagcatcagcattagcatcaggagcaggtggtgtgagcaccagtcgtcctggtcacgccggcagcatgtactcctcgacccctttgcagggatcgtaccagcaactacctggcacgaatggcagctaccacggccaaggagccagtccgtcacgtccaggcatcccagcgacgcccaacatccgtcccgtgcccgacatgcatcatagccataaccataaccatggccatggctctagtagccacggacaccacagcaccagccatccgcaccacggcaccccaccattaccaccacctccacagaacacgcctcacggatccacgtcctcctccgtgtccggattccttcagcaacacacgcccaacgcaacacccattcattcgcatgcagggagccttcacggcggtagcaatggtggagtgcgacgcgggtcagaaatatttccggggtcgggaccagcaggcaggacgtcggcagttcttgccaacttgatcggaacaccgccaccatcctcgacctctttttctcacggtccttcttcgtctcaagcaaggagcataggaggcaacagcgcagcaaattcacccacaggaactcccgttttacggccgcagcaattaccgtcgaatgctgtgcctggtctatcattaaaagaccagcctctcaagagacaccacagcacaactcgccagagcctggctgcaaaatctcaagtgcgacattcgggaggccgacgggtgctggaacgacccaatttgaccttacccgtgcctgtcaacattaaccgggcgtatattgccgatatagacggtgacggacagaacgaactcgttctggcaagaactgaccggatattacattcctactcgctgcaagcagctaacaaagcgacctctccaacaatgagccactaccccagcaaccagccactcaatctcgtcaagctgctcagcaggacaagcagtatatcgaccctggacagcagtggattgttgtcaccgtcagacgacaggaaggatactgtaatccattacccatccatgtcgtccgtcagcaaacagtaccacccgggtgctgcgggcgcatcccagaatgtcgcggatgcgcaggatagcggcgtgcctgctgctgataatatgaaccggctgattcttgtagagaagaagcgctgggccttggacggacaggtaagagatatggccatatgcgtcgctttattgtgttacactgagctggggtcatcaagggactatgatcattccaaactcactctgtttgctttacatcacagatcaattgtctttctgttacccacgatgccagtacaggacagccgattctgttggtggcccagccaggactcaaatttattatggtggatcacacaggacagatgtcggagcctgtcagccaagctcagcgcaacccaaggcctggcagtgtagctggccccgatactcccactcgttgtgcgggatcaggcgatgtagccactgatattgtgtgtggcactcgctatgtcaatggtcaaagaaaggatattataggcttgatgtccatggacggtaaggatctctcctgttgactgaatgtagatcgtgtagcgttcaagagttgacagccatagtaacgtattctatgacacatacataggtgcgtttgctctccatgatctggaagacaacacagccaaagtgcacgacctcgattcaacgcacaagatttttggattctcaaaattgaactttggcaactgttctgtgaagaatgctgctctgtccggccacagaaatcccaagagatcctatgcggacgaaaacgcttttgatgttttccataatggtcatggtgccgaggaaactgacagcgacgtggacgacatctttgcagcggaggacccgctgcggatccgggaaggcgccgccggtagcagccgtgaaaaaagttcacgattaaggagaaaggagggcgctcaaggaccatcacttttgttatcagaaccttacggctcacgattccagaggaatgacatgttcgtgggatgctcttggagcggcattacgttctttatcgatcaggagttcaacattgcgcagtatgactttgacgctcgtgtttgcgcatttggagcaggtacagtgacgaccagcgtccttcgcttttgtaggtgacggtgttgtaatcgtaacagacgcaacgggtagatctaaccaagggtcgcttttattctttcacaggacaatacgcagtgacccctggtcgaaatgagccctgcctcttttacgtggactttgaggacaatatatacgtctactacaacttgtacatacaaaccgaaccgccgcctcagttccaagagatcgtcagggcggatacggatctggtaatgcgcagtgacgaagcgacttgttcggcgactagaaagtacaagcttgcgcgtgcgcggcgtagtgtaatactcacccacaactctttataactataggttcaccaaagccgaaagttccaacttgcagagagggcatcaaaagagggatgtgcaaagtcagaatccgcctctgccgagctctcattgggccctctggacactctggagaatcgcacggactttactctggaagagagcagcgcgatggcggcatccgcttggactgagcacgacatgaaggactttattcacgacacgctctacaatgcaaaccgatacgaagatgaatttcagaggctgaagcggcttgccaacaacgagcgtgccaagagagcagcgtactttgaagccgaggcgaacaaggggcgagaactagcggacgcacagaaaaaaggcgtagcagggcctgccgctgccattggaacagatcctgctatcggaccagcgtcgcgcacaatctctaagccaaggcgacctgcttatgttcgaaccactggcaccaacgatggcatggattcggcctcagaagcgctgccacgccgtagacaatactcaggatctgactatgcgagcaacctcgggctcatgtcctctgaatatacccaacaccagcagcagcattctggcggtgtccgacatcagttgcctaactccccaggctcttcatccgctccgtcgtccccaaaggcgagccagagccatcttggaaggcggaggtcctcgctgttgatcaaggatgtactcttacactatgagggtaagatcactccgcccatgaaatcaccgacgtccccttcggctgccagtccattcgtaccaggtcacggcaagtcgggctcattcagcgtcagtggatcggcagcgactctgacgaatatgatgaagcgcttcagtctaaaggatataggcaacggcggacgactctcccgatcgtctacggcgagcagcagtggaagcaacagcagcaatggcagtcaaagcaccatcacacccggacatccacttttgggcgcgcctacgacgaacaaaggaatggcgctcgagaacagggtcggcatagccttgaaggcgaaccgacctgcaggtgcgccgcggaatcgacatttgggtgtcatgggtcgcaagctagggacccggtcgcgtctttcattgcagcaggaccgcgaggatgacacagaggaaggggaggaggatacggagcaggcaccttctgatgatgggaccgttgacatggatggcgacaacctgcttgaatacgaggtgtcatcacggagaagtatgggcgatgacgaggatcagcgtgcggcagaggaggaggcggatgctgtggtagaaagcaattatagacgcacaaggagaacgagccacgaaccgcaggagggtgaagacgacgctgtaggggtttataccccatcgaccatttcacccattccgtcaccgggcagattttatagcactcagcataggagtgggacagaacccagcccgagcctcgacagctcggcgtatgccctcgccaagagtttgctttcgccttccaatcgcagtgtcctgagtgggagcagcgaaggagccatgggcaagcattcgagacattcccacgcggatcaggacagctatgctcatggccagacaaccgcagccggggctcgaggccatgctcgacaacgatcaggacatgggcttttggacgttggactaggggtttcgtccacacgcgaggtcggatcgcagtcgagtggattttgttctggacccaacagcgcgggctatagcagcaaccaggacggacgtcggtcaagagccgaatcggtgctgagcaccggttcagacattggaggagtcattgttccggatatcacgctgttggcttcttcattccccgtgcaatcttcattttcgctatcgacatccgaacctctgtcacaggcggtgattcttggagatgaggatgaagatgacggggagagtagcaatgacgatgacgtggagattgctcagggcgacgatatggaccttgatggtcagggcccaagtcaacgagcgactgtcatccgaggcgatggaattcgacggccaccacgacggtccgctacgctcggctcccaggatagcgcgacgcatgttcccggatctggagttgggtccggaactgtcaatgcgaagctgggcaataagccaagtagccgttctgctacggagggaaagcgtgtggatgtgaagctgatgccggcgccgttgcctagaagtagtcagcaccatcagaggcatcaattggagcagcagggatcctcgggtaccttgcaaggtcatggtggcaaggaggggactcatcaaccttccagccacgtctcgttctcgtccaacacgcgtccaaacagcagcagcagcagtatcggccaaccagatcaaggagacacgcagggtttgcatggaggcggcgggagcgaagggtttgggcgtggccttgccggaaagtcatcctcgacaacatcttcagccgcagcgtcagactttggatcaggaccatcctctccgctgacaacgaatgtcacgtctgcaaacgctatattgtcgaacccttcatcttccaatggcttcaagggattcagcgtcctctcacttccagtgacctcaccctcggcggccatcgttgcatctggacagcagcatcaatacttttcagcatcgcactaccacaacgcacccccaagagcagcgcatcatctcgcctcttcactgcattctcgaggtagtggcgggactcatccacacgacattgccgtgactggtggcagtggttctggtcaccatgacgacgaccgatcgtcgatccgatccaagacctccacctttcgcgacgttgacgatagcaatgacatctcgtcggtccttgctgcgggagcgtcgttcacaggaggtagcaccgggggcggagcagttgaccacagtgtctataacatggcaagggcgtccgcgtccaatacgcatctgcaatccgactcgttagtcaggcggttggaagaacttcagcagcaggatcatgatctggaggagcgacaacgccagaaggaaaaggacaagggaaagagtgcagcagcagcagcagcagcagcagccacctccgcagcaagctcgaacaaggtgcaggcacaagggaggccctcagcgctttcgcgtgccaacagcggcgccagtgttcagagcgtgatgagccacggtggccaacgagcgtcggtcctgacgcatggaccacccaccagccatggctctggcactggtgtcaacaccagtggacccccctcgagccaaggatctgccacaggctcgggatatggcaaggtagtcgcacgggaggatgaccacgagtcttcgaggcgacttaagaatcgactcgggcttggccagggtctgtgaggatgatcagataccgctcccaagtccctttttgaaccattaagaccatttagcaaaaaagaaacaaatatacactacactgttgtggcaaagcccagcaaactggttgcgagaaaaactggttgcgagaaaaaaaaagtattattaattgtgtacaatgtgcttgtgtgtctatgcagccttggtggtcaaccgaatgccgtgcatgcccttgatctcctccttcaaagcgtcgttcaccagacggtgctgcttcaccatggagaggtccttgaacgaagggctgacgacctcgacctgatacatggatccgcatccacctatgatttgaaaagtgtgccatattccaactttgagcgcattttcttgaccctttctttttcttttttttttcttttcttcgagggggtccgagagatgcgtgctgttttacctgaaatgtcctcgacaatgagtttgctgggctggaacttctcaaaaagcttcgagtagaggtgcttctcgccgtcgttcagtgccgcgggtggggtcgaaggcacgacggtggaattgaggcggggcaacgacgtggagaagaggcggtggggaataaagacggcgcgcgccattggaacgagagagcggagtgacattatggagacggggtggccttctttttttttttattgcgaatgaatggagacagaacagggaggtcgttggtggtggattgcgaaaaatccgaagactcgagcactctcagactcagtgctacccggcagatccgttcaaagtgtggcttttgcaacataaaaaaatcctccccggtcagatctcgcaggtctacgctctgttctgcggctcctagaacagcttcttcttcttgggagcccgctccttctcgatcttttctcggtcaagccgttcctgcagtagccgtcgccgctccagttcctcggaacgctttgatgcctaacacggagacgcgtggaaaggagagaagaaacgagtgggaacgaagaaaaaaaaagtcgcatgtcacttagtttttttggtcgttgtcttcatgcggagcaaactagtacctgaaagaggccatcttttttttttttaccttcgttcccgaactctcgccacccgaggatgcagcaatatcccctgcaggtcttggcactgtcataatggatgatggttcagcgaccccagtgcgagtagtggttctgggcagagagccctgactacctatgctctgatcctgcgatcgaaccatctcgccctgactagcgagcgaaggatctgtagagccattgcagatcaaacgaaaaaaaaaaaaaaaaaaaaaaaaaaaatgagtagagaaatagaagaccagaaaagataaaaggttatatcaatatgtccagcgtcagttatgatttttttcttcacattgcaaaaaaaaaaaaaaaaaaaaaaaatattgctaaaagatccatacccttctccatagcgttctttgcaacgatcgaacaaagcgccgacaccttcttgtccgaaaagagctccctgggacctaacatctgtggtctgacttgcttttcaagctcctcctgcagtttggtctctgtccgcgccttgtcatagcgttcggtggcccgacgccggctatggtatcctgccccactctgctccaacatctcgagggcctcaaacacttcgttctcttttgctttgatcacgttctccaacgactttgcttgccggcggtaggcgttcgtcagggagatgagcggtaggatcaaatgatcgtacaggacggccattccatcaacctgagcagggttttgttgcagaccgctgccattgcagctgtcgttgtcattgtcgttgttatcttcctcttcctggtcgctgtcttccaaaaagttgcgacgccgtggcaacgtcgcttggtcttgggtctttcttgatttgcgtttcaacattgaggatgaatatctgtgctctggcccaccacccaggagagtatgtacgttctcggaggtggccagtagtggcgacagcttgaattcccattgcacactcgcgataccgtagatgaatcctacaacgagtgagagctggcatccgtccccgtcccccccaagaaagcgattagcacaagtgagcgggtcaactggccctcttgaagcctttgctattaaacgaacaatcatgcggagaaaaatgcaagcgtgtcccggtgtggtatttccagaggttgagactcatggagctctagagagtaaaaaagttcactcaccttttcgccgtggggctcgagatgccgtttagtgctcgagtccaatggtgtaatgccagtgtcttgctgcgccgtaaagatggctgaaagcgacacaagtagtgcctccagttgagaatcttcctcgtacgcaaaacttttgatgctctatcgtcaagtgcgagcgagattgtcagaggtactagcgggttaaaaaaaaagttgtgcgacagtgtaccatgcattcaagtcgttccttttttttttttcttccccctcacctgcgatctttcccgaatatcctcaatttcgagcttttcataccagcactgcttgaggttcgtcaagaggatgaggtagtacatttcactttccgaaaagaatgtcttgaccaaaaaggtgtcctgcccctgctcagaaaaaagtccctcctgcggtagacccatgtacgcagcagcggacgctgatgcggaggagccagcgatggcagcgacctgttgtgtgttgaagagcatccgccattcctgtttccgaagcgtgtcgttgtcctgtttggaaagccgtgtcatgagcgaatacttttgtattatgaatgggggaggaaggcaacgaaaaggtgtgatgaagagatgcgacgcgttgcgcgctgtggaacaattggtgattctgaaacacagccattttttgccaccaaaaaaaacctgacaaaaacaaaactttattttctgtgcatgcgtcgcatgtccccacaacctacttgagaattcttttgcacaccttttttttttctcgcccaactgctttgactttcctgttggcttttttttctttttggaggccctcccagtcccatcgtttagcagataacacagcacgagttttgctttttggccgtcttgtaaaacatcttggactgactcgacaacacatccgaacgctccaccaaactctccatcttctcgccacgctccagcacggactcgatcgtcttgtgcaagatgatcttggtctcatccaactcgcgctgaaccttcatgatggtgtctccttgcttgggatcctggtacgtgacaatgtactgctgcaactccgggtaaggtgtctgttctggtgtgctccaagcactcgaactggggaatttggtcgtgaactcatccaagatcttgttcaggagtgaaaatgccacgcggggaggatactccttgtccgtgatcaccacgcctgcgatgccctctgctctagcatacacatgacccacgtagtctatactcagtcgaatggaagggtgaaaagaacaaaattacaggagtgtgaataaggcgggttcttgcaacaccaaaaaaaaaaacgttgtccccactttttcaggaagcaaaaaagaaacaacagcatagccaaggcactggaaaaaagaaacgttactcgattcctcaatgctctgtcgctgtccaggctgggtcttttctgcgatcgtctgggccataaaggtcataaactcggcaatgctagtagttttttacagtcgaccacaagcgttattattagcaacgctttgtgcgcatttgccctcttgctgtgggccacgtgtcagtgtgaatgtgaagcacccggacaacgcagccagctcgcatggtcgactgtcataatgcagaccagcgccatttttttttttttacctagagcgctggaagaatccaaagctggccagctccttggcatcgacaacggccttggcgggcttgacgccgttgttgacaacatagatggcaaaaatcttcatggcgagtgggtgtctacttgggcgagagagcaagagacaagagaaaagaagaaatggcagagttgagccgaaaggaaaaaagaattcaaagccaacggacgatggtgcatgcagctggtccgatgaaacaagcgtccagaagtgccaagcaaccctcaggagacacacatgaagggtatttacgttgtgaagagagaggcaagaagatgcagtcagtgaatgaggcagagaggacgacgaaggggaagggaaaggacgagagcgaagaggagaaggaaggggaaatgagatggtgcaggacagatgatgaggtactgacgggatacgaaaggagacacaaaaaacgaggtgtgacttttgagtgtgcaatgaaaattgagggcccacactttgttcattcagaagcgagtctcgtgtgcctccagcacagacactaccgaatcagagatgtgtatcgtaacgtgtgcaagggctacccctgcacaactgcaaacaggccttccagccctaccttcatcagccccggatgcgctaccgctagcgctcgatcacaatggctactgcagccacccacaggatcgttgtagactgtcacatgcagtccgaacatacagttggctgaagcccaatgatttacgcgttatattgctctctgctggccgcgatccgctgaactaaagctacctccagataccttgcaggacaggagcgcgctcctcaaggtcgtcctcaatctctgtcaaaatttcgttcatcaaccaagcatctgcccccaggcgactcgtcagcaacgtctgcatctcctggaccttgatcatcgtcgacgacagcggaacgggtgaaagtggtggcgaacgagtattcgagtccatggtcatgaacggtgctgtcggcggcgttggcagccacgacctgtcgtgcctcagaccgctcattcccgtcctcggcccactgtcacaggataccatcgaggggtcccctggctgcaatcccaagaacccctgctcgtacttggagtccaaggcctgctgtaattgctcgttctcacggttcagtgcctgccgtataaaggccgaaacaagcatccacactagctgatacgcctcaggcgagcaggccattttgatcggtatcacagccgatccagccgaggattgtcgcagggattgccgctgccgctgtcgttgctgttcttgctgctgctgccgtttttgatgatgatgatggtgggggtggcgagggtagtgagggttgaggtgattgctgtggttgctttggtgatgttgatgttggcgatggcgttgccggcgggatacgatatgggccacctcgcgacctttgtacgttgctgtgaccaaaccgagggccaaccagatcaagtgcttctcctccactacagcgcctgtcctcaagtaatcatacaccttcaagttggtctcgagtgaataaacctcgccgtccgtgtgctgtgcacacagcagcaattcctggtccagacatccattgtcaagcagcaaagagccatctccgctcacccgcacaatctcactccctccgggcatgtccgcaacagtcgaagacgtgtggaggataatgtgatcgttcgtagtccagtcaatatccagtcctatcagctcgttcctgccatccaccagcccctcagatgcctcttgcatcagctcgtcctgatcctcgtctaggttcgcattcttgggactgccgtggttatgctccgcaggcagccgacgaccaagcactttgcttttgacctcctcccatggatggcgacctcccatgatgcttctcgaccgcgattcattttccattgtctgacaccacctctccagcctccagacctgttggttgttccagttcagtaactcgtgcagggcttccatcagagcatgatcgaagcacgtctgaaacgctggctcgccgctcatagtctcgagaacccaatccgacacttccggatgaacaatccacgactccagcttcaaatttgaaagagtttcctcaaaggcaatcttccactcgggatcctgagcggcagagacatccatatgaatctcaaatgcctcttgaatagctctgttcacgagacccgttgccagcgtcaaattttgggtgtagaattcaagaccattgtggtcatagtcgctgttgttgtcgttgatactgtccttgttgctgtcgctgcgattaccgttgttgttgttgttgatatctgttgagatggctgcaatatcgtccattgcaaaaagcgattcctcgttggaggacgccgcggaagcttgggttgcctgcatgcacttttcaaactgagaaattcgctctgggttagtcccctctgctgcaagtcaaaaaaaagaaaaaatggttactgcctcacacctggcaaaaaaaaactccataataagtcatcttaccagggtaatcaaatgcgctttctcaaccatcatgggcgacgtcccgccagggacctgcagcaacttcaccagttgatcctgaaccaccgagttgtccatgccaagatccgacatgaccttcaagatactatcaagctgcgccgggggaatgcccttcaagacctccgcaaagtcttcccggcgaaaatcgatccgtttgggcttccttccatatcccaagagttccctctgtacagtagcgactccgacagccaacggcataacatggggctccatggacgatggcttgtatacatgtcggaccatcgcatgaagtcctgggatacaacactggagcagcaatgcagcggagacgcccgacgttcctgcaggatgctgaatctgaagctcgaatcccctctcaaatagccagtccagtacctcgggggccttgtgcatcaagtagacgaccatcgtctcagtacgctgcaggtcataaaaataccagatcgaggtcccttgccccttgagtcctcgcttgttcacgacatgacttccatcactcggaaattcaaaatcctcgcccgagtgcgccctcactccgcctttgtagtgcgctttgcggtcctgatcgtcctctggcagaggcatgtatccatattcaaatatcagtgtccgaagggtgctcagcgagagagaaagtggtccatcaatgatgctgggaataggctttttgctcttcttgggataggtcgccaaaccatcaaagatgcccgacgcaatctgaaagagacgcgcgtcgtcctggaccatgcgcatccgcgtcagtagataggacaaatctctatgactactgtactgcgtgcttgagacgggcgattgctggaggcgtttcatccacaacgcatccactcgccgccccaagaacggtgatggaggtatgttgacgagatcatcggtgtccatatgggcttcagatccgatcatgctggtgtaggcgacccgtctccagtattctgcagcagcctgccgttcagtcgcgacagtcgcaggggtgatgggtgtatacgtggccgcggtagagtcgaacgccaccgccatggctggctgacaccgctcacaatagcgcaccgcttccaacaaaagatgcctctcctcccgttcctcacaacgctggttcgccatggctatcctctgcctctgctctgcctcatcctctacgcccatcctgccgtcgacgcccgcgctgccgaagcctcctccaaccaaggccggtgatgccgcatatgcaatactgtatgggtcatcctccttgatgccgccggcgtcattgtcttccatggatccaggtgcctggccctgctgctgatgatgttgctgcgcctgacctcgtgctgggaacggccaaggcgagccctgacgcagtggtgcctgttgaagtccaccaacaccagtgctgactcctgcgcctcttgcttccgcctttttatcttctgctgctgatactgaagcagcagcggcggctgttgatgggtccttgagatgcgccgcggggacgagcaagtcctcatgactgatattccaaaatgctcggccccgaataacgaaatatccatactcgaggcgtgctcgggcggtcaagtagcgaactgcagactcggagagggtgcgcttgttgccgtaatacccaaagtggagtcgctgtatgaggtgtcgagagagaaccgcccgtggacgagtcgcaggagcaggtgggctctcttggacctgagggtgtgcacgatgctgatgtgcgagggactgcgtatgtgacagtgaagtgacggacgattggctgtggtcgtgcggaggaaggagttcctcgaggagcaaggtcgacaggagcgccttgtggtgcttgagcagcatgtgaatgaggcaccatggtgggtactgcagactcagcgcgtgggcctgtgcctgtgcctttgctgcactggatgctgtggtgtccattggcaagggcaaagagcagtgctgaatgagtggacgagcgtgaagagtgaggaagacgggacgactgtgcgcgtggacaggaagaagcgacaacagagaaggagacacgaggcaagggtggcgagcagcaagagcaaagaagtacaagacgacgaggagaatgagtgaagtgagagagtgacgagagcgacagcggattgcgactgaaggcgtctgctggaatggaggcgcaggccagagacagacgtgagtgcgggtgagcaatgaggcacgacgcaggtcaaggcaaggcaaatggtggcaaacgtgtcgcgggagggacaagaaacagagaatgggttggagtcaagaaaagaacaaaaacaaaaaaggcgaatgagaaagtgcaagagggataaaaaaaaaagtgaggggtgcgaggtgagaggggcattgtgtgagataattccagattggccacacagcgcgtgtgcatccaaaggagaagatcgagtatggggcaagacagcacgtcaagcacgtcaagcacgtcaaagacacaccaacgacacgtcaagggcagcgcccgacctttgagcaagcagagtgagtttcgccattcttttattacattaaattatgcttccttgctgagggcagaagaccctcgtctcctcctcctcaacaggcacatcagcatccaccagaacaaaaccaaacaacacatgccatcctccgctacacaatttcaaacgcctccccctcctctgtatccacacgcctgaatccttgtccagcattccgtcccctcatcttgctgccctcgcgtgccgcaaagaacttcctcgcctcctcggcccagaacaccgagctggtcaacagcgtgatgcccagcagatccatcagcgtcagcgcctccgtctggaagaccgtctggaagaacggcacgtagatcacaaagaactgtccaatgatcgagcccatcacactaaagttgaacatcttgttggtcgtaaatccgatgctgaagatcgacttcttctcagaccggcaagccagcgcgttgaacatgtcgaaaaacacaaacgtcgtaaaggtcatggtcgtgtcccgggccgtcacactgccgtccgtcatctcgtgcacgtacacaaacatcgtgcctgccacaatgatcatggccgacgtcaacacacggcgcagcaacagccgtgtcaagatggctgcatccctggcgcgaggtggcttcttcatcacatcatcgtccacaggctcaactccaagtgactgagctggaggcccatccatcaggatatctagacaacaaaaacgacgacaaaaataatcgatggttacatcagtatgtacggtcatttgtacgcgcaaaagcgcttagttctatcttgcttgcaggtcatacaacagcgtggcgacttactgatccacagaatctgcatggcgttcaaaggattgttcagtccaaacagcgtcgacatggcgatcagggtcaacgcagccacactcgtgctaagctggaatgtcaaaaagttttgaatattgtagaaaatcgatttgcctaggtggtcggatttttcaagaacagagaaaaagttaggtttcaactctctctttcaggcagagcaccgttttcacacaaggtaccattccaaaaaataaacataatcccgcttctttaccttcttcaacagcgccgagaatggtcgaaaagtcatcgtccaccagaatcatatccgcagcctccttggccacgtctgttccgctcctgcccatcgatattccgatatccgcaagcttcaaggctggcgcgtcgttgacaccgtcaccagtcatggccacaatgcagcctttggcctggaacgccgacacgatcgccatcttgtgcttgggcgttgtgcgggcaaacacagagatgttgccgacagcatcctgcagctggcgctccgtcatggcatcaatctctgctcctgtcatacaagatgccttgccaggattgacggggaacccaaggcgtctagcaatagacagcgcagtcgcgtctacaagaagaaaggcgaacacagcggtcagagaatgaagagcataagtgaaggttagccacatccatgtccatatcgagaaaaaagcaacagattaatgggcattgatacgcagtagaaccacttaccagcgtctccagtaatcataatgaccttcacaccacttcctacaagtgttcggacgctttcctccacaccgggtcttggagggtcgtgcatggccacaataccaacaaaggtcaaacgttcaagatcattgccaaacgccatggccagcacacgcagcccgtgagtcgccatctcgtttgcctgggcgagcaccttgtccttcgcttcaacatccatgggcaagtgatgaccttcgctcctgtagtagttggcacatcgctccatgactggctcaatggcccccttgaaataaaatgttccaggtgatccgctctgactgacggtcgcattcgttgggtcaatagcatgttctggcgtctgcttatggctgagctggcttccgggaataggtgcgcaccgaacatgcatgaacttttgatccgagttgaaagggaactctgcaatgcgctcgaaaagctatagggtacgaaaaaagcaaaggatcgggtcaatgatacatacgatatgagatagtcaatcatctcagctgatatgtaaaggagaaggtcttacaggtcgctcgtccgaaatgttcagtcccttcaaaacctcaatcagggcaatatccgtgggctgtccgatccacttggagtgctcatccaagaaggcattgttgcagaggtttccaacttgcatcaggcgacgcaggcctggatggagatccacatcgacagtcttggcctgatccagatccactggaaatccctcagccagagtaaacaccttggtcacagtcatcaggttcatggtcagcgtgcctaaaagaaatgaatagaaacgaccatattgacccgtcagtcatgctgtaaagagtgtcagaaaatgcctactccacgcacagtgataaaaggctcacccgtcttatcggcgcagatgacattgaccgaacctagagtctcgacacttggcagtttcttgatgatggctttgcggttcgccatcctcaacacccccaaagccagagtcacagtcacgacgatgggcaggccctcagggatggcagcgactgccaaactaacaccgatggtcatcatctcaagccagtgctttccctgaaacaatccgatcagaacaatcactccaatgatgatgaacgacagcatcgacagcttctttcccagctcgtccatgctgatctgcagtggggtctttctgatctcgacttcttgcatcatgcagaacaccactccaaactcggtctccttggacgtgccgacaacaatacccgttccatgtccgttcctgaccagcgtgcccatgtatgcaatgttcttgcgttcagtgatggttagctctgcatactcatttccaaccactgcctcaatttgcttgcggcagggcttgttttcacccgtcaggttcgactcgtcaatttcaagatccacagcctaaacgatggagatgcgcgcgtagagttaaggaaatgtgatcgacagttcatcctgcatatttcgatacctgtgaatcatggctccttaccgtgaccagtcggcagtcagcgggaattcggtccccgatcccgaacttgacgaggtcgccaggaaccagctggcttgccagagtcgccgtttgagtatcatccctacaattcgtgtcagatatatcaaggttgagtaaatgccgcatgagcaaactccagcggagtcaagaagagcaaagtagggtggtctgacgagacaaggttcagtcctgcgagggctggggaaatgagatgaaaagaaattccttcgagcttgcttcatcccagggctcacttgccctcccccccctctccctctcttttctctgtccctcattcactgatgctcacaggccgtatatccgaccaaagagaacagccagaaaggccaaaacaagcagagttcatccaccaaccacccaggccactgtggtacagtacagcacaccagctcccatcgcctgatagtgaggctcagctgatcccgcagcttcattttgggtaaaaattcaaccagtcaaatactgcaggcacgatccacggtaaacggtaaatgtgataacgagagaaaagaaagcgctcacacattcacactccacttcagaaggttgtatagcctggaatttgatcagactgatagggttggatcatcttaccgaataacatggcaatggtgcgggaccagcttgttcagggcctcgagcgatttctcggatcggtactcttgcacaaacgcaactaacaatagaataagagaggaggaatgggacatgttcagatcagggactgatgtcaggaacgttcctttctgcctatgcatgtccagcaatgtctgaagaggatgatccatatgccattttgtccctttcatgcctgccaaaaaccacccagaagacaaaagtataaaatagcacaaggttgagggggtgatgggcctaatagagaaatagggagttggcgatgcgaactgtggacaatcaatgtcgtatccatttgtccaaagcccgcgaatcatgccacgacatgccagatctgccaatgaatgttcaaggaatctccctgtgacaccatgcaaaacggcttcctttcagcactgcatggcttcacacgctcagtcgtcaaaacgtgagcttgagtcgagatcgagtcagccaaaaaaaaaaaaaaaaaaaaaaaaaaaaagagagaaatcctatcgtgtactgcgatcgatgcacttggtttcaacaagcccatttgtcgtttgctgtggcgtcccttcgcaagggcaaagaacgagaagggtcgcataaaagggggtgtgggttcgggggggaagacgagctgcagtcgtgcgcccgatccaagcaatgcacagggaggatgtcaaaactaggcagtgaacagacacatagcgaaggcgtcgtgaaccgcaaaatgtcaacgacgagcatgtctcggtctcctgtccgccatctcggatcaagtgtcggctccgtttctggctgggcgcccatgttttgctgacggttatgccacccacacgcaggtgcaaaggaagaagaaaaaaaaggcgagcgaggaatgatatgcgtccactgctagcacgttttacctgttacaacaataagaatggcctatcaaagcataaaaacaaaaagtcgggggatgagcttgagcacttttctaagaactaatatccctgcgaatatgccaataattccacgcgaaaaaaaaaaaccagagcatcctgtcggttcgtgatctcgagctaagcttaccaaagtaatgctgatggcatcatcgtgctgcttcatcgccagcgagacagcagcagatgcgaggagcaggaggatgagcgggttctcgtagaagctcttgaagaactttagataaatgggctcctcgtcctcgacctcaaactcgttgaggccataccgaagccgacgattgttggcctcctgcgtgctcaatccgctgatggcactggtctcaagctgcactgccgtctcctcggcagtgcgccgagcgtaggttgctgagggtgtcgagatggttgcctgggtggtcatggtcatggggtcctaaggggtcggccacaggtaagactgctgaaggtggctccgatgacgggctgggattgtgtggtccctgagctcgcgatggaaagaggaccagatgggtagggatgtctttgcagccaggcgggagggcctctctctctgtcgtgggtataagaggttggcgagggtgtgttggtatgagccgcggatggttgggaaggtggttgctggagaggaaagaagaggaagcaaagacggacttgcatataaacaaaaatgagtgtcggtatggacaaagacagtagtatgtgtgacgggtgcgtgaaagtgagagagaatggaccctgccaatccctgatcagcacatcaattccattcacttagccagaaatagatcccctctcgccctttcttccctccttgtctctgcctggagaggggaaaaggcagggtagatccagggatccagcacacgctttcggtgtggcgtttgttatcgatgcgatcttcctatggctatgcatctgcgggtattgacacgtacatgtacctgcctgtgtgcttcacaatgcactccggctgagatgatgctcacacagcccattctgcaacatggacgcaaggcaaacaatgtcagaacgtggataaaacatgaagagacgcgaaaagacgattaaaaaaagaatgctttatatggacttggtacatcgacggcctccaacctctcctgaacgctttatcgcgaccgcgagctgctggctctacgccggccctggtgttgctgatagctgttattgctgtcgaacgtgtgcatcggcaccaacacctcgcctccccgtccccgatcattatagccactatggctgcgatggctcgagctatcctgatcaaagttgatcaaatccagtgtggacgacccgttgtggaagggagagaccgaaggtcgtgcttgatgtgatgtgtcccgcatatcgatcgagagcgagtccgagttgtactggccgccgcgcccagtgttgttcgaccgctggttctggttgctgtgggtgttgttattgctgttgttccagtccacaaatgtcgttgctgcctcggagtactggctatctctggaccgctccgtcatgggttggtgcctggtcgcaaatggctccggggactcgtcgtgcaaacgctggaaggactgctggtcatcgcggacgggctttttgaaataggcgtccttcttcttgatcttcttggtgttcagtccagtgggcttcttctgcttcttgggcgggggcacaaactgcgctgctttgtaaaccttgtagacgccaatcagcacaccgataagcataacgaccgccaccagcgctacgacgataatgcctttgcttggatccatcacccacacgtcaccagccacctgcgtctgaatggccatgtttgggggccagccactggtagtgacttcaccagtggtcgcggtggccggagcagtgccctcccagcggatagacgtaatgttggcaccggtgccagagttggcccactggcccgtggtcgaaccgatgacgatttgacaaaatctatcttgatacaggttcagggccgagcgcaggtcgctggtcgaggcactggcgaacgacgtgccctcgacaatgttaatggctgtgcaagagcccttgggaatggtctgaggctggccgatggcttcgcctgcctcgttcagcaaattcagagtaaggcccgctcctgcagcctgcgccgagaccgttgggacgttgagagacatcagtgccaggagggcgagtgatgaggtgacgcatgatttgaagacgcgcttcctggaaggtgcggatgatgagggtgaggaggagatggatggcctcgacacagccagccgactggcagcatgctgctgctggggctgtgagtgatccattagtgccaaggggagggaagaaaacaggtggatatgagaggaagccagcagagactatttactcgtgtgagaaatgaaagtaggcaaggggggaaggagaacaggaagaggacgaggacgaggacgaggggagggggaacaagaacagagtgcgatacgggagaagcggagaggtacagtgagaccagactggaagaaacgggtgtgagcaatggtgttgcaagaagagagaaaaaaagaaaaggaaagaagggaaagaaacactaaacgacaaaaaattgaagacaaaaaagagtacacgctgcttaggaatgtcttgggctggtgccagtgccaaaagactgcgccaaaggaccacacggccagacacaagagacagagcaatgggaaaccttggaaatcccggaacatgaatgcgcacccatacaacacgcactcttgggggggaaagcagtgggcagtgagtgcgcgcaagtgtgcgggagactctgggcctattttgagacgcttgccatgggcggagacttttttgtgcaatattgtgtgagccttcttggctctatttttatcgctcgacctcaacctcacgcgacccacctgtgctgcaaaatcaaggacagccatctccggcatcccggtggccctctgccacctggaggcatcctcacgcgcactttgagcaccccgcatccatcaaagcacggactttgcactgcatgtgcctgacccccctgcttttcaacccccctcagaatcatcattgcaaaatacacaacctcaatcgtgccagcgctaaattgggcatgaaaaatgcaaccttgtctgacacgcgagcactagatccaggcctctcgcgtagtatctcttctatgtgaagctccttggaatgcacagtcatatgcagcacatgtataataatacttgtcttatgaaaaggagatacaaaacagggcactttcattgcataaaaaactggaatttacaaaacggagttgacgaatatgtgcattacaattgcgtggcgaggattgttatgaagaaggtgacagcagaatgaagaaaagaccccaagggcggggagggagggagagaaggaaggagggtacacgagaaagcacgaaactattgaaatcagagaggaacgaatgaaacatcagcgatgtcacagctgcaacgagaagctgttcgactgaggcacttattcttcgtcctcctcaacgtgatcaacggccatattcatgcgcttgtccttctcgctctccagctggccatagagtagatacaatgccttctcgttggcctccaaagtgccaacaatggtgaacatgcgctctccagtttcgtcatgaggcgtcttggcgatcgagatacgagaacctgagaggcgacggatctccgagattttggagcctccctttccaatgatgcagccgaccatgtccgcagggatggagatttcttgcgtgcgcatgttggagctgttgacattgctggcctgactaaaggcttcgggacgagggcgagtaaagtcggatccattgccagtacgcgcaccaaaattagagcgaacgcctgctgcaggtgctccactggcatatccgacagctccaggaacgcgaggtcccgaggggttgtagagaacagtgccgacaccacgctcccagtcgtccacgaggcacttgccgatttcatagatggcgattcgaagggcatcgttggatccttggacctcgacaacgcgctctgtggactgtgggagcatttccttggaggcaaccatgcgtgcgccggacgcgtcctgaatttgcttgatcttcagtccttgacgaccaatgatggtgcccatcaagttgtgcgagatcaagagtcgcacggaggaggtctgggcgacaggacgaagggggttgatgggggtgctgggaggcgaagacgttatagggttctccaacagagtttgcgcaataagcgaaaaggcctacacaacagaatggattaacgttaatgcctgccgctcgcctgtgtcagtgccagcctcagtcgcacagaaacgcaatcccaaggacatttcgcaagcacaaagtacacaaagcaaaaatgcaagtctcgctccagagcttgctgttataatcacaacccagagagaattccaaaccccaatgggtccctggtcagagatccagtcccttaccttggcaacgccctcgatcgtaccagtgacagtcaacacgcggtcatggactccttggacaaccttcgacacaccggccttgacacccgtctggtcacgaagatcggccacattctttccggccttgccgatgatcactccagcttccttggtcgacacgagcgcgcggagagtcaagggagcctcggggtcgaggccctcagcttcgtgggacgcctgctcgtggtcgtgctcaaactggctgtggttgtcgtgcgagtccgcgtgggccgaagcaaagctgctagagactgcaggggcggtagcggtgttctggagcgtcatgttggagatacgacgggtggcaggctggttggagaagccctcgaacgcagggaaggaggtggtgaaggtggcggcagaggaggcgaggctgtcgtgcgtcatggctgatcgagagtacggttgtttagtgaggaaagagaagggacgatcaaacgatcaagagaagtgcacaccggagtgaagaatgggtgaagaacgaggtgtatggaaagtgaaaaaaacaaaccaaaggtagagtgcccagagacgatgggtagtcgagagtgagagagtgagagtgagagcgagagcgagagtaaaggggaaatagagagacgcctgtgcgctgtttaggagatgaatggatgagactggcaggaagggtgaagagatggactgaacgagaggggggatggatttaagagggattatggcggggaaataacgcttcacaacaacaattttttttttttgcacacagaatggcgttttatgaaaagggaaaaatctatcgtacagggatgtcgaatatgaagatggaaaagtgagagggacaaaaaaagagtccggacagtggtgtatagcttaaaggaacatctggccagactgcgtggtgacagtcgagatcttctggatggcgttgacaagggcagcggtacggaagtcagtgttcttgagcgcggcggtggcgcgagtctcctcgcaggcaccaatcatggtgtcctcaagtccagagtacacaagctcgtgctcctcagctccgtggatcacggcgcgacgctcctgaggggtcaactggcgaccagcgttctcttcgaccaacgtcaggagcttggacttgccagcctcttcccacttacgggacatacgtccgaaacggacgtgcgacaagttcttcaaccactcaaagtaagagaccgtgacacctccggcgttcaacaaaagatcgggaatgacgaccttgccctgggaaacgaggtaatcgtgggcgtcaggagtgatgggaccgttggcagcctcaccgatgatcttggccttgatgttcttgacgttcttgaggccgatctggcgctcgagagcagcggggatgaggatgtcgcactcgcgttccatgaccttgatggggtcctcaatgatctcggcattgccaaagccacggaaagagcccttctcggcacggtgcttgaagatggcctcgatgtcgagaccgttggggtcataggcagagacatcgtgctcgccaataccaatgatcttggcgccgttgttctggaagaacttggcggcccagtatccgacgtttccgaatccctggacgatgacagtcttgccagcgatctcaccattgagaccagtcatcttctggacttcagggaactgcaagaactcgcggacaccatagtagacaccgagaccagtggcctcgttacgtccacgaacacctccttgggagatgggcttgccagtgacacatccggcagcgttaacatcctgggggttgaactgacggtaggtatccatgatccaggacatctcgcggggaccagttccgacatcgggagcggggacgtcaacaccaggtccaataaagttcttctggcagagctccatggtgtaacgacgggtgatgcgctcaagctgggcaggggtaaacttcttggggttgagcttgacacctcccttggcgcctccgaatgggacatcgacgacagcgcacttgtaggtcatcaaggaagccaaggcctcgacctcctggagatcaacctcgtcagagaaacggatacctcccttgcagggaaggcgatggcgggagtgctgggcgcggtaaccctcaatgatgatgtgggtatcagcgtcaatctcgacggggaacttgacgctcaagacggcatcgacagctttgattccggtcaaggacttttcggagactccactgatcttggcggcctgtataaatagaaaggacaaacatgtggaaacacattgttagctactgctgcacccctgccttatctgactacctattccttgtcttgctctcacaactatcgccgagtggacgacaagttatgctccactgaaaacaactgccacaaaagaagagagttccccgtcgcctcttcctcttttgacgtgtctgaacggatcagactcatcctgctggtcgccccgccccctttaatgatggtcgagtcaacaattcaaatgacccccactcatatccctactcatattccaaatgaagatcccttgctcgtctttctcccgctcgccctcctttcccacaatttcccgccttacaagcacatatcccagggaggtcatggcgaactgcatattagacaaaagtgacatacgcgatcgtagaaggtctcgacggagcccaagaaaccaggctcgtggtcctcgcaggcagcgttggtgacatgcgtgctcatgaagcgagcaaggggggcggcggccgaagcacggtgaaggcgaacagccgaggccaaagagctagtcaagttgagaatacgagcaaaaaaagggaaaggctaatggttaaacggggtgcattccttgacaagcgtcgcgcgtaatcatctccaaactgcatcagctgcctcgctgtcttccaggccagtcggccatcagaagacgagcgcgatggaggtgcggatctgatggcgaaggtgcaggttgggttgggtggggattgagaccgactcgttccacgataggcacttgtggtggaaggcagcagcgacacgactcatattgtggccagttgccagaaggggttgtggcatgcgtatagacttacccaggggttctacggagaagagcagcaaccatgactggatgtgtgagaggagaggagaggagagtgtgggggactggaaaggaagagagaaaagaagaagagaagaaaagaagagaaaacagaaaagagaaaagagaacaaaaaagatcgatgggcccacaacaatcaaaaaggggcggcgagtcgaagcgaaacaaccaaccagcccacacagtccataggctgatcccctccacactgaacccacagaatccaaccagcccagatccgtcgctgtcgattggaccgcaccctgcacagggcgcactttcgcctcattccgcgctgtgtcatcgtagttggtccctgaccggcacttctcttcccgttcaggctgaacgagatgaaaactgctgcacatccgtccatgcccctcctctgaggacaagccgatacgatcccgcgcagctgttgccaggtgaacaaccgtcgtgacggccagagccagccccactttttacacttttctacactctttttatttttctactcagttgtatacgcaataagtatttttatttttgggtcaactcattcttgcccccattcaaaaaaattgtgtcgcatcacatcagccatctatccctcaagactcaagagccaaaatgaaaaaaaagagtatgaggacaacaaggacgacgtctcgctcgcaccaatacaacgcttgcgacagccacatcagcgtcagtttagatcacatctactacgctgcgtagggcatcaccatagagtcaaccctcgcaggggcacaacaagcacagatattccagatgcggcccaaaaggatctttgacagcgcttcgagtgtggcagacataccatgtttcttctctaaaagacaatgtttacccgtcgggctgtcctcaccggctcatcctctcttcccgttcctcactcgcctgctcgcccagcacaccgtctggatcgccctgtttgtgttaaatattgccacggttcggccacttgccaaaaaaaggattcgcgtgggaaatttgtggggggaggggaattgtgcccgctggttttttctcagtttacaatagcgagggccgttggaaatgaattcgacaacgaaaacaaggtccgccacgtcggtctgaacagcataatgtcgacctgaactctttttgggatctgtgaaggctctgcaatcgatgcattctgtcctcagccaacctctgtttctactgaaactgctgatcctcagccatctcgaatctatccctcacttgagtgcccatttcacagagtcaaacagcaaccactccaaacgaaaatcgagcagtgacgagggagacaggacgtgggagatcgaccccaagctcgaaactggggtgagggtggggtgctttcatcagcgacaacctgccttgtatgtccgtgtgtatatatgtactagccctcttgtacttttgcagccctttcgtggggtctttgaacaaggttttcttttctttacttctgtgtgcaggtccaacccctgcgctcgacttccccacatcaccacggtacatgtgcatgtacagtactcctcccaacaacaggcgccacggcagtcggatccagagtttgcgcttcaagaagcatcgttttttttagaagagtaacaagacattgaggctttaacacaaacaggaaacaatggagacccagatcgccctttctctctctacgctctccccacgctttacggattaaaacgccgctcacccttgcccttgatgtcgccatgttgatctggattcccctcatatagtcgtatggcacctcgctgtcaagaagggggaggcgagagatagatcagccatggccgatgacatgtttcaggaaccgatctggtgtggatatgcagcggttgattaaacacagtcttccctcccatcctaccctacctcagagaagatgattgaccgccgcgacctatgcgtctcattcccgcttcagaatgatagttctgcttctctttctcagctccaaactccactctgtcctgtttgacaaacgagatcctccctgttcgcgaaaacataacaaaaaaaaaaaaagtacaagagatgtaagctccgcctgatcaatcacaagctgccagagctctttttcttattgtcctccccacccacccctcttttcctgaagaaggaatgccgaaacctgactctgctgctgagaagcccatcccttgcgattttcaagctgcgcgcgcgccggactcagaacgtgttataggttattaatacatactgcaaaccgtcgccgccactcagccgttgtgcagggccatcaaggtgcatggctgtgtttaagggtgcgtgactggctcatggagagaaaacactcctcatgcaagacacccaaagcacatacacagctgctatcaaaaacacacgcaccatgaccagtgccatcctcgacctcttcagagcctaccgcgaagaagagcaggcctggatccagtccctacagacccataccaacaacgagcaccgcacggcttcctccactctcgaggactgctcactccactatggcgagctggcgtttgtactcgcaggcctcaaaccctgcctgctgatccagctgccgacccccgagctcaccaccgccttttacgaaggcgttatccttccacgtcttttgacccaccccgcctatattcggctctcagccccctctgatctgggtctgagctgcaagccgatcactggccgcatccgctcaccagaaatgtccctccagggctacgtgctcctatggtctcgcaggacggttctcgcacacccgcaggcagacctgatccagcgagggatcgaccgtatatgtcctcaagacaccacgatccctagcagagacaagtctgacaacgagcatgccgaagatgaccaggaggaagaggacgagatatcagaggaggatctcgctgtgatgttggacatccccggacgactacccaagacccatgctgagatgctgcagatgatcgaagtctcgtactggcaccaggccggcagctctaacgctcccggcagcgctccagtgacagagccgaccctactgacggcctttgcagcgcagccagatcagatacccgagatccacgctcacttcaggaggtacaggaccactgttcttcaagtgcttgaaatgtccatccagctccatattcagtccatggcggacatggccaaataaacttcgtttgcggtcttgcgaatgcaagagaattttattatgtaccgcgatactgagtaaaggagcttccgttttttcttttttctttttttgttgttttgtgtgagtgttcaaggtgttctaagatatggcgctgaactatggtcaagaaaagccaggggccagggaggcgcgatccaacaacgcaagcgttactctctgggtgaggatcgcttaagagtctccagacgttcactttcttctgcttgaccgcgaactcgtgctggcaggtgatgccttgttagcgactggtgatgccctgcttgacactgcgggcgaggccttcctggaggtcgctggtgacgctttcaaagatactgctggcgacgccctgctagatgtgatgcctttggccttcttgacaggtgcctcttctttcttctaaggatatcatatagacgtttgaaaacatgttcgcaaaaggtcagcagttttctatgtgtgtacaccgccacagcggcccttccataacaagcagagcataaacgattctcacggtaccgttgctttcacgggttcgtcagacttgtcatccgcgatcaagcacttgaccaggtaggtgcatcgtctggagagctccaaaggcgtccggctcttcaagaaccaatcgaatctgaaaagagggctcttgcggatctcatctctgatcctgtcgtaaacatcgtctgtgccatacccaaggcgctccagcatgacaatcagaaatcggtcttcttcttccgtgtagttcttggtctttgtctggttgtacgtaatcttgagctgctggagaggaacacggtgacggtgaatcactgcactgagctgttcctgaatgtcagactggcgttgaagcttgctctctcccttctcaatagccgcaacaatgcgttcatgatctaagatgcccggtgtgaaagagacagcgaatcagcacgacaccaggaggcgttttgcggatatcgcctgcaactgcgcatcaaacaattgacactcaccagccacttcagtgtatcgcttccagaacaccttcgagtaggccttgacctcctgcacagtcttgccctcgagctcgctagcgatttctgcatggttgttgcggccaaacttctcgcaggccttgtaaaacgaaatgaagtcgcgtttgctccagttttcaaagccctaccatcatccagaagtatgatcatgtgggttagtattgctgcgacctgtttatagaacattcttatccaccatggacagagcttgcacaatacctcttccaaaagccgctccttttctgcgacttcttcttccgtcaaaggctctgccgtgtcgatcagggcctgctcgtgctgctgctgctcctccagctcctcatctgtcatgctggcagcctctggtccaatagtcttgggtacgcggtagccaatcgactttctgtaaaacaaaatttctctgtcttgaagctcgttgaggcgaggagggtagaactgaaagtcgttgatgttgagcgcctttgggggacgaggagccttgactgtgggcgcctttggtgcaacgcgcagagcgtctctataataatcgtcaacggcatagttggccttgcgctctctcttggctggagcaatccacagcagactgccgtcggcctttctcttgtggctccagtcttctccttgccagtcataagcacttccatctttgctggtgaagttctgtaaatcatcaagtccatacgtcgcaaacttttgattcagctccgatgtcttctcctgaccgcgggcgataatttcgtcgatatcagcatcgaatgtggatttgtcagcagcggtatcctgaaacacttcggccgcaccatgctgaatcattgtcagaagctcgtccttgttggcagtcttttgctggtgagccatatgtccttgctggatgacaagttgatccagtcgtagcttttgcgccgcacgctccagcaccttttcttcaatgccattctaggtaggatatgggcgaagaattcagtgagcatgaaggattgtaaattgcaagcgattctcatctcttgcgcacgtgaaggcaagtggttacctctgtaacgaaacggtacacatagacctgcttcttctgaccgatacgatgagcgcgatcctgggcctgaagatccacctgaggattccaatcactgtcgtacaggacaacaatgtcggctgtgaccaaattgatgccgagccctccagccctggttgtcagcaaaaagatgaactttgaactgtctggcttgttgtattcgtcgatggcgctcactcggtcctcgtggtttgtctgaccatcgatacggcagtactctattgagagatacaggcaggctgttaaatttataattccacccacacaagttttgaacggaataaatttcacggcactgcctggttaccatatccacggaagttgcagtaatcttccaagatgtccaagacacggctcatctgactgaaaagaagaacgcgcgagcccttctctttcatgcgcttcaagagtttgtccagaacaaccatctttccagcattgtcgacaatgtgttggtccgtcgtatagggtggtccaggctccgcaccatcaaagaggtaaggatggttgcaacacttgcggagttgcatgacaatgttcagaagtcgggtctttccctctcgcttgttgcctccagctccattaactgcgtcgatgtccttctcgagaatccgttggtaccacttgcgctgcatgggcgtcaaaccaacatagaggttgatctccttcttgggcaacagactcttctccacgtcggccttgatacgacgcaacaggaaaggtcggagaactttgtggagctgctctacaaccttatcctgatcgccaccttggttctcgaaccacgaatcgaaatcctctgaggaactgaaaacatcgggaagcaaaaagttgagaagagcccagagctcgtgaaggttgttttgcaacggcgtgcctgtgatcaagagtcggttcttggagttaaaagtgcggataatctgagaaagctgcgaattctcgttcttgatgcgatgagcctcgtcaatgacgatgtactgccacgcaaacttcttgatatgcgtcttctccagcaaacagatgtcgtaagaggtcaagcagacgtcgaacttttgtgtcaggagtgtcgaacgaatcatctcaccctaaagaatcgaagaggtaaaactgcatgagataaacggaattctcgagctctcgctgctgacgacattctccaaagaaccggtcgttcgtgcccaccctcgaccacttacacgctcctccttgcttgcatggagtaagaagacattggcatccgggagccacttgttgaactcgtttttccagttgtggagggtcgactttggcacaatcaccaaatgaggtcctgggacgccctggacgtgcttcaagtaacccaaaaacgaaatggtctgcaaggtctttcccaaaccctagtgagtgtacatgcatgtcaacagcgttagccaacagctttctagactatatacatctcgttggcttggttgaaactgagtaaaaatccgtgcataccatctcatcagccaggattccgttgatgccgttcttgtagagagaaaccatccagttcaaaccctggatctgatagtcacgaagaactccgttcttgatatctgaaatgaggcaaaaatctcgccgttagcaaacgagcgcacacattggatactgcagactggcacttgtacattttatcaaacactcacatcctggcgattcggtaaagacaaacgagctatcgtcgttctcattctcctcgtcgttcaagagctcctgatcctcttccttctcagtcttacggccctgtcgtgatcccttgggggcattcaccttatctttatgcccctcactgcgctccttcatcaacctggcaaactctgggtccttggcctttttcagatcgatgaagtgcttgaacagctctatagtatggcggatggatcaacattagatactcatgtccgagttgcacctctcaggtgacttgatcccaacattgatatgtacctgtctggccgaggagatatgagatgcggttggatgtgtctgccagctgcaacaaaaaggagaatcgagtcagtggtgccgctgtgtgtttcatgctcattgcgacgttagggtagatagcggcagatcggcggcactaaccttgtccttgtccatctggataagatcctgttcaaacgtatccttctgttgcttgattagggcgcgatcctgctctcgctggactttgcgctcggctttctgaatcttctcgagttccttctttgacatggtctctggttgctcatcagcctataacggatcgatatgattataaagaatgagcatcgataacctaacgtatttcgggttgatttgagcggtcgagacttgttgtctacatgaacttacactgtacatagcctcgtcctcagagacgcggtcaacctaggcataccgtagaatagaatggtgatgtcagtgtgctacactggtctccaagacaaactcgaaacgccttgcgcgggcaacaaggagtcagcgtcatacctctgctctgtccatggtgatggcgaatcgatgtctaggttgagtggaaaggtggcaaaagtaagaaatgctggtcgaccggttgatgaatcccttgtgctttgacaacactgcagcaacgcgtgaagatgcagccccagaaaacctacgagtttaagtggaggtggaaaataggcttgcgtctgtgataagtggtggctgcaacgacaagaaagtggaaacggacaaggagaaacgagggacgggcggttgtcgagtgtctgcgggtgcttcaagcaaaagactgagagggggttaatgggacggagagttgatggcaaacgaagacaaaagcgagtgaacgagaaatatctcatatgcttgtggcacaggaaaaacacccaagccacactccgctgatttggattgaccgcgctgtattgacttccccaagcgcgtcataacttgttcgagtgccttgcagccaagcgattgtctttatcaaagaccagacaccgcgaagtagattttaatatggatcttgacttggcagtcgtcaagctggatcagttgctacctttcagcgacgggaatcacctaggaggcggctgcctagagaacctactacggacctatgagtgactgagctgccttatcaagggtacaggcgcggctttcgcacttctacgataagctctttgggcgcatggatcaggaatgaagagagtgctaacacgagagcatgtcgcttgtatgagccatcatatcgaaggtgccatctttcgccgtagtccagtctgagacgcagacctaaaatgtgtatttcctgtatgtgaagacgtaatcagcaggaaataagctaaacaaaaatcgctcctccaaaggcgcggtgcttgagtttgtctgcgatctctcttcttgcgcttcattcctcactcattcgtcgacatggaagttcaaagcgtcattgccaagcctgaggacgctgaagtagtcaggttcgtacctccatgttcatctttgtcagcaggaacacagcaagtacattcaatacccttaatgtctgaccacgcattctcacatctaacctctgtgcacaggactcgctcaaggtccaggagcagatctcgctcagcctctgtcacttcagctcgctctcggtcgcgctccgtctcctctcgctccccctccaggtctcgttctagatctcgttcaccaaggaggtcgaataagagaaaggcacagtcgcccgaaggctcacccgtgcgttcaagcaggagaggcgaaggtccgtccaaccatgtggacaagcgaggaagggacgattccaggactcgctacagagacagggatgcgccaagggatcgcagcaaggagtatagcagggaccgtgcaagcaacggatcgcaggacaaatctcgtggtggacgaggtcctgctccagtgaggaaggagcaaaaggtgtctgattgggatcagaatcgtagacgagagcgtgaacgacagatggaagagagagaacccctggtgccgagaccaaggcaggatccagtagaggagagaaaggcactgatgacgacaacccgtacaggaggtgcctatattccaccagcccgtcttcgtatgatgcaagagcagatcacggacaagagctcagtcgagtatcaaaggatagcttgggaggccctcaagaagagtatcaacggtcttatcaacaaggtacgcaacaaattcttcaggttgccaatgaatgccctgctgtctttggaatcgtttcatatacttacaaacacgcaaaatctctcttaggtgaccgcgtccaacattaaggccattttgccagagctgttcggagagaacttggttcgcggacgaggcttgttttgccgatcgatcatgaaggctcaggctgcttccatgccattcactcccgtctatgctgcgattgtggctgtggtcaacactaagctaccccagatcggcgaacttttgattacgcgcctcatcgttcagttcaggaaggcttacaagaggaacgacaagacaacttgcctcgccaccacgacatttatcgcccatctgacaaaccagtgggtcgcacacgagattctggctcttaaaatcctgtttttacttttgggtcagcccacagaggactcgattgagattgcagtaggatttatgaaggaagtgggatcgtttttgtcacaggaggcctcaggagcaaacgaaggagtgtttgagcgtctacgcaatatcctgcacgagggcaagattgagaagcgaacgcagtacatgatcgaggtcttgtttcaaattcgcaaggacaagtacaaggataacccacccatcgcgcccgagttggatctcgtcgacgacgacgagcaaattacacacacccttgaactggacgatgacgacttgaatgtcatggagggactcagtaagtcggaatctgaattggatgatccttgtcttgtcggtggagatatagatggaaggataataacagttgtaatcctctttcgttgctgtagatgtcttcaagaacgacccggattaccttgcaaacgaggagaaatacagtgctatcaaggcagagattctaggcgaggatgatgactcggacgaatcaggatcggaggagtcagatgatgacgaggacgaggaagagagtcgtgaggcactgcagaagaaaatggagattcaggaccgaacaaacaccaatctcgtcaatctccgcaagaccatttacctgacaatcaaaagctccctcaactttgaggaatgttgtcacaagttgatgctcatccagctggaaccaggtcaacaggtaagcatttgattgactgtttagtgtggggcttgcgtgatctgatggcagcgatctgatataagaattttctcgttttagattgaactctgtaacatggtgattgagtgttgttcacaggagcgaacatacgaaaagttttatggtctggtgggcgagcgattctcaaagatcaaccgcgactgggcagaggcgttccaggagtgcttcgtcacaaactacgaaaccatccaccgattggaaaccaaccctcttcgcaatgtggccaagtactttggacatctcatgtcgacggacggactgtcctggagcgttttgagtgcgatccatttgaatgaggaggagaccaccagcagctcgcgcattttcatcaagattctgttccaggatttggtagagtctttgggcttgaagaaattgaacgagcgagtcaaggacccttactgcgcggaatggttcgcgggcctctttcccaaggacaatccaaagagcacacgctttgctatcaactttttcacgagtattggcttgggagccttgacaacagatctccgcgagcatctcaaggtatgtctggcgaacgcttgcgaatattttttagctgtgttgtgtaacatgcagctaatattgatatggtccccccttcttttccgttcgcagaatgccccaaagtctatcatggcacagcaacaggacgtagacagctcagactcggattcagactcggactcggacagctcgtcgtcgggttctgaaagcgatgtctcttcgtcgtcttcttcgtcctcgtcttcgtcctctggttctgattctgatgactctcgtcgtcgccgcagccgtcgccgccgtagaagccgatcttaaatacctcatttctgcttttttgggcatctaccgcacaatatataatgaaactacagtacgaatacttggcgagtacgacgtatccacatcgacctgcgcatgagcgccagtcattctaccgggtgagcaccctgaggcgcttgacgactacgtcacttaactctacaaaagcgaggaaaagaccaaatttgggtcttgctgatcagcccactccaatccctcaccttttccttccatgagcgcattcatcacacgggcaacaccactgtcagtgcacgctgcacagggttgtggccgagttcccatgggcctctcccggttagggaggacctctgcctgggcacccgcctctacctccagatcaggacctctcaaacgtcgcattcaaactcgcttttactcctcagacaagcagcagccccccaaacccagccagaatggcgaaggcaacaagcccgagaacgtccccaaaggctttgaaaactttttcggcaaggctcttcgagatgcagccaagaaggttgagaacagtggtggccagcagcagcaggcgccaaagtcaggaaacagcactggtagcggaagcaagagcaacggcaacagcagcagcagcaacaacaacaacggccacaattcgggtcaaaagagtaccggcaactctcagcacagcaatcaacgtcctcctcacaagaaaccaaccccgcctccagagaaccagctctttgcgatgaagttcaacgccaacactgcccttccgattgcattcaccacctacgtcctttacaaggccatggctccctccgagaacactcgcgagatcacgtggcaagagttccggtcaacgttcctggaccgtggtctggtggagcgattggtggtgttgaacaggaaccgagtcaaggtatacttgcgtgcggatgctccaggacagatccccggctctctgggacagccccatggaacgacatacacctttagcattggatcggttgaggcctttgagcgcaagctggatgaagcacagtccgagttgggcattcccggatcagagcgtattccggtctcgtatcgggaggaggtcaacgtcctggggacattgatccactttgcaccaacgctcttgctcgtcggtgttcttgtctacatggccaagaagggcggcggaggtgctggacagggaattttcggagtcggcaagtccaaggccaagttgtttaaccaggaaacggatatcaccgtcaagttcaaggatgttgccggcatggacgaggccaaggtggagatcatggagtttgtcaagttcttgaagaacccggccgcatatgagaagctgggagccaagattcccaagggagccatcctcagtggaccccccggaacaggaaagacgctgttggccaaggctaccgcaggagaggcaggagttcccttcttgagtgtctctggatccgagtttgtggagatgtttgtcggtgtaggagcgtcgcgtgttcgtgatctgtttgcaagtgccaagaagcacgcgccctgcatcattttcgtggacgagatcgatgccattggaaaggcccgtggcaagggaggtcagtttggaggaaatgacgagcgtgagagcactttgaaccagcttttggttgagatggacggctttgggtcgaatgaacacgttgtggtgctcgcaggaaccaaccgaccggatgtcctggacgacgccctgatgcgacctggccgattcgatcgtcatatcgccattgaccgacctgacatcaagggtcgtggtgatatcttcaaggtgcatttgagacccatcaagacggaggaagatattcccaagctggcacaaaaactcgcagcattgacaccaggcttctcaggagcagacattcataacgtctgtaacgaggccgcattgattgctgcccgccacaacaaggagacagtggttgaagccgactttgaggccgccattgagcgtgtgattgtgggtctggagaagaagtcgaaggtattgtcgcccgaggagaaaaagacggtcgcttaccacgaggctggacatgccgttgctggatggtacttggagcacgctgatcctctgctgaaggtgtccattattccccgtggtgtgggcgctcttggatatgcccagtacttgcccaaggaccagtacctgtactcgactcagcaactgatggaccgcatgtgcatgacactcggcggacgcgtctcagagcacatcttctttggcatgatcaccactggtgctcaagatgatcttcaaaaggtcactaagatggcctacgctcaaggtaagagcttgacaccgtggtctctagtactatcgcttttgatcatgtgctgcagttcaaaagaaaaaggatcgtagcctgatgaacttttttttttaaactttgcactccatagtcgccacttacggaatggactctgagcttgggccattgtcgtatggcaatcccgagaaggagaaccagttcacaaagccatacagcgagcagaccggccagttgatcgatagccaggtccggtcgctgatcggaaaggccttccgcaagacgacggaactgttgacggagaagcgcagcgatgtcgagaaggtggccttgctgttgatggagaaggaggtgttgaaccgcgccgatatggagcgtctgttgggcaagcgacccttccaggacaagctgcatgagctgctgggaactgaagcagctgcccaggacgagaagtatctgaatggacctacatctgcaccagcaaccgattcccctcttcctgcagatccctcgagcacacctccagtataaagattttgttatctttttttttatggtcatctctctgttgcccactgttttctgtaacattagacgcgctgattgaataaaaagatggttgaatgatatggatcgagcgttcgtagattgttgtcgagtgctgggcaggaaaactgtgccttgattcaatatccacaatgaacggctcgatgcaaacatcacgagtctcttgacgaacaatcgttatatattacaagtttgtttttttttcttcaccgcttcgatatgcgccgaatccttctatgcagagctgtcatggtggaaaaccttaggcaccctgaaccaaatcgtcgctcacaaatcggtccagaattgcctgcttcctcctcttgaccagatattcctcaacctccttctgcgagggcacgtacaaggtccccagagactgtgtcctctcgccctgtccgtcgacctgcatgccgttctcctcaccatcctgagcatcctctagcgccttttgcatggctttctcttcctgttcctcctcaaactctagtagagtgccatcttcctcatccctgtatccatagtagtcagcatcgacattgcgaagcagttctccccttgtcttttccttcagtgtcaccgctatattaaaaaagaaaaaaaaaagaataaatgaacctgttggagatccacttcacttgtctaaaggccgcttgatcattgttgtgacaggcaacataaagactggagacacgattgcgcgcagacttacgtggaggctggaagagttccttcactcccggaagctccttggctcgtccgaaatacttgtatccacgcgcacctgggacctctttgccctgagcatccatcgtctttggacccgttatctaaaaacgaaagaaaacaacccaaaatcgcaacaggtttggttagtgacaaacagtcggttgatccaggactttttttccaggggacatacagttgtcgcttccacgattcattatgtaccctataatcgacacctccaagatccttgatctgttgctcccaacggtacttttcgcgcatcagcttattgatctcgtcgttcaagtcccggatctgaaagtcggacagtccagctaaaaacaaaatacatatcatggaagatagggcaaaatggtgagttgctgtgcgtgtgcggccgtcaaaacctctcccccttcactgagcacatcaaaagaaaaaaaaccgaaagaggtgtattcgataccatcttgaatcttggagaccttctttgagatgtcaccaatgcagttgcggcgccatttctcggcctccgtgagcgatgtcacttctgaaatgcggaagggtctccgctccagcgtcttggatcctccgagctctgcattctttgcctcgcgaaagcgatagagcatcgatctgttacgattgaaggtcattgatttagtttttgagttgtctctctctgtaaaaagtagaacgactgggtcggattcctcccagtcaacatatcaaggaccccctgaacgtactgtgctttctcttcatttctggccatggtgctgagtgatgctgggtgtcagaggggatggcagtgaacaaggacatgcaacgaaatccacagactgcgacaacaatatgaatttggtttccacgtatgcgtacgtgacaagtttaatctacttttttttttctacagctacagctcgtcgtggcgcgcactgtcgtccttggcctgctctggttcaaccgcggcctctctcacggactcggactcggactcggactcgttgctattatcattagagctgtcctggccatgatcgtcatcattcgcgtccaccaagacggggcatgcggctggcgtctgcatcttgaacagatactcgcatttcgccggctccgtcacggagatgatttcgttctcaatgccgcaagtcataactagcttcacagaccggtcggggccgttccaacacctggttcctcctgtgtacatttgcacattgtgattctcgccctcccagctcgagaatttgctatcaaggtacaagcaaccatcccctttgttaagaatggcccacaaagagatacaatatacacatgcccgaatgctgcccatacacacgaggccttacccaaggaaagtagtactatgggatcgttgattggcatcaccaaaaagacagatggagtaggtgtaccttgagaaagaagggagaaacagaagggtgttagcggaccgtaccatacacatagcccgatcagacgcttgcatcaaagtccgtcgcatactcaatgtctttaaattcgaagcactgatcgagcaactgggcaaaggtctcatcgtctccgaggtcaatgtccagtttgcgttcaatctcccgaatagtgtcccgagtctgcgtttcttcctccgaagccttatcgtattcagcttgtgctagatccgtcgctatgaaggacagacattgtgagcttgtttagtcaaaaaagacaaaaaaatgaagggtggcaaaaaaaagctgaatttgttgtccattttccactgaccttcccgcagcttttcagattctgggttagcatctgattcctctacaggaatgtcaagaggcagctcatctttgaactcttgtcgatcctcgttccacaagagatcaaactcctctgcaatcttgaccgccgccaagacagcctcatcgttgtactcggtattgtactcgtgcttcagacccatcaaaaggtcacggagtgtcacaatctcacgttgtatcgcgaacgtctcatcgctcagacgcgtcagttgctgatctgcacactcgcccgtgccacaggtgtcgctagagtcgtggttgtcatggctggtactgtcgctaccttctgctgaatcctcagcagcactctcgttcagtccagagacgtactcatcgaatccagagacggtgttcttgaccgcgaggtcatggtagttcttgttgtgattctccttgagatcctgcaaggtcttacgcaggctatccctcgagtctcgcgagtgctttaagcgtttagtctgctcctcgatcaaaggcttcagttgcagccggcgagcctcctcgcgcttgttcttggaaccctccaaaaacttttcctgcacctcagtcgcctcatccagtttctctatgtaatgtgcgagagagcaacggtagagaaagttgagccgttagcgctaggaagcctctttgaatcccgatatccatgtaaatgcgatacaagacacatgatgtccactgaagcgaaccttttgcttctgaggccgttttttcgatctgatcaatctttgcctgcaatgtctcgagctcctgctgcagctttagcttggcagtcttgccatgctggatgtactctttccgcaaccgacttccttgctcctgaatcgcctgcacccgttcccgctccttcctagcttccctcccaacctcctcgcagacgttggggcaatgcacttggccatcgtattcatccgtgccatcgcagcattcgggttcgcagactccgtcgttgaccctagaagtcttgatggacgaggggagatgaccaacattctcacagtgaaaatatcctgttccgcaggccgaagtgcctgaacaaaaagtcaagaaacaagacctgtcaagcagtgatttgctagtcactagaccgaagaacgggggccgaacaggtcactgagtcgactcctcaggcctcctcaaaagatgcttacctggctcatccgacccatcagcacagtcgcagtaatcgtcgttgactgcagagaatgggattgtctttgatccatccagacagcgccaggtttgagtgttgctgggcgtgtacagcttggtgtctatgctccagtgtaagtggtgacagaggtcgcagctttttccgttagagcctgaccgacgaagcatagtttctctatacctcctttccttcttcacttataacacgactccttacctgatggcgatactcctcgaggggcgctgctgctgccgacgagcgttatggccacactgattgccagcgatgcgaagagtgggatgtaggcatgacgagacttcatcgtgcagcggtttttttttgtggagacagggacagcaggtagggtactacgatggctcgcttataatggtggtgaagcgcgaatttggcacactggacgcgacgggtttgagagatggagtcgaccggtgaatgaagaggagaacagaacgttgggcgcaacagatgatggactcgaagaaaaaaaaatgtgacgtgcagcaggggccgcacagctcaggcacggaaattatattggattgcaaaggttataggtcgaccttggcagagtagtctctaatcttggaatagatctgctcttccaggccatcgccatcgcgtcctgctgcgatcgccaacaggtccttcgtcacttggtagttgcctagaatgtccacatggtctgctgtcctcttgcctccacgaatatccaccggagagggactgctgtggtgcacaaactcgcgggtgatgacctggatgccggccggattgtacagcttcttcttccatccttccacacacatgtatcctgtcgagagcaaaggaaccgttccatctctataacgtcgcagatccaaagcacaatcgttcatcagaacatggacatacaaacaacgcgtgggcatgacattcgatttcgatccaaccttacccgtcgccttgatggacaccatagctgataccaagcttctcgtcgtggaccgacgtgtcgatgtaaatcttcggaacctggctagtctcgtccgaaacatttcctggtctctggtcgaaaatctgcggggtgaggtcgctcatacggttgtatgtataacttcgctcggtcgacttgccaacaccgtacaggcagtagatcttcatcttgggcgccttgggaagcgtggcctccaaggggttggaccaacttgtagctagcttgtcagacttgtccatctctgactgggtgactgaggcgccgacagtgtaattgtgagccagcatggcgttatagtcgtcacccgctgtctttgaaagcagcctcatgctatcgtccatggtctggtcctccatgtccgagccgtctgcaaatgcgagcatcgctccaaacgacggtgattctttatcgccccaattgcccctcgttgttgcattgcgctcttccgcgttccttgaaatcttttcctgtaccaatgtctcctcctcatcatgggttccatcatccggtgcaccttgaattgttccccagatgcgattgcctcccttggggatcatactcgtcagccctccccagctcctgaatagatctgcgcgctctcgtcttgaaaagaacttttccagaacgtacgcgctgacgactcccagctgtgcagtatctcgaacttctcctgaaagcactgcggctaatgtcttgggtacccccagcatggggcccgcaatgttgacaaacgtatgaacgtgatcgctgacccagttgggtccgcctttgccgccttcctcagattcgacccatttgaaaaagtagaacaggacggtggatcccatggagtgtgcgaccaagacatttttctcgcctgtgactttaagcgagagctctagactggacttgagtcgagaaaagtagttgtctctgttttccaggttggcgaacgataacctccagtcataagaagcgagatgcatgttgttgttgtcatatccaatggctgccaagttctaccacgggccacaaaacgatatcagtgttagaaaattaacgcgaacgcatgacaaagactggtctcatgggcgctgtcaagatgtaccttaataatgggcgcccatacccagtacctacaatgaccgtaagaagcgtcagagtacgcatgattagtatgcagtccaaggcggcattggttcgtctcgatttttttttcctcatggcgttttgcacgtgaaaaagcgcgcaaagtaaacgacgtaatgcgctcactcacccctggacaaagtagtcggcagcttccagtccctgagcggcgcgcagtcgaacaccttcggggtcaagtcctgactttggatcgagtcgcatattagtgatccagcagtctttgtccagtaacacggctttaaacatggctagaatgagggacagagggaggaggaggaagatcaataagaatcgatcacacttcttgagaacgcgtaaaatatatgaccgccacggcagaaaaaaaaagcagatgtattacttgtcgttccccacatgcgtttccgaaagtacttttgggagcagttgtgtgttgttgaccaagattcgagaccagtcgatacgattccaggaatcatggtgacctaagaacaaaaaacaatacgggcgatgagtgatcgctgccaacgctgtctagtccatccatccacggcgacgcgactgcgacgatgctccttgctcttaccgggtgcttgggtttatacccttgctccgaacgcaatgcctctcctggatagaacagctcctccgtcagaatctccggcttgaacagggctgaaacattccctatgaactcgtctgggatcatgccggtggggaccatagaggccaggtcgaactcctgaaagtactgagagaaggcttcgatgtaggctgcatccttggactgtcgcatcaagactgtcgccagacccataccgatgatgataccaagcaagaggatgacgcgacggcgtgtggcgggggggacgtgtttactccggttcttggcctctacctcgctcacgaacagggcctggtgcagatagtcgcccacggaggggttccggctgagagacgggtgcctgacctcgatcttggcatctttgggtaatgatttagacagcttagtgatggtagccttgatctcctcagttttgcattgggattcaggttcaacgtggctcatacggccacttccgttggcatgtgtgtcaggagagtcatgtgtgtcctgtgcattttggctgttgttgttggtatggcttctggcggtatggttggtactggagttgctgttgctggtactgtttttggtggcctgcttcctctttcgcggtgccattgagggcggattgagtggaataagggtgtcgtgttgattgaatgaaactggatcaagggccactttgagcattcaagaaaatgaaacagacaacatatcggcttaaccgtctgaagagtatgcaaaaatacacgtcaagtttttgactatgtcatatcggttggtaaaattgggcaatcatattgacgttcgacagtcttatcagcacagtacgtaaaaacatgtctacagctaacctacctcgacagatgtccgtctgtccttatttgcctgtctaaaaggacaggttgggtgcgttgaggatgggcatgcaccgacgttaaaattctgtaggctgctatcagggggctgggtggccttgcgctgttcctgggggggttttttttgcttaccgaagcgtgggatcggaggatggaatcagaaatagccggcgcccaaaaacaaacaagcacacacacaccagcatggccattcaaggcagttgcagtacaacttgcttagggccgaggaacaacactgtcaaagaaacagaggcacataaacgcgcgtcagggagagaccacttgccgccgcgagacagcctcggctcattgaaacagaccaaacaacagagcaagacaatcctcgcaaaaaaaatgcaacgtggtcgagaaagacatgcaagctccagtgttcgatctgtcgatagcccataaaggcctacgcgaatcgggtccagtcctttccttaggagcatcttttcaagagaccgacggccgtagagtgctgtaggctactcagttctagtctgtcatgcagagcaaccgcaccctgaaggacaaggttaagattgaaggtgtggtacaacatgcacagctagcacacggtgtgcccgcagagcagcaaaatgagaggtggaccgttgtgggtggccacgttgcttgggtgcagtacgtacctgcacacgatgtagactacagtgtacacgagaacccaacgagcgagaaaacaatagaaatatttccccgccgttaccttgcaggggtaaatgctctcaacagcgcgattgactggtcatcagacccgagtctctgactctatgacataggctacattcatgcgatccgccgagcagtggcgccataccgatataaatgtatagtagtctattgtggcggccagccaattgaaccatcgcctgtccacgtcatgtccgctcgctgagttcagctcatcccacgttttttggctccatagttctccatactgtcatcacactagaccaagtgtaagcagcgagcagccgagcaaacggtgcttgcaacgattaattgctctgtcgatgcaggtcgccaggattgctagctgcagcgagtatcgaagtgtcgatggcaacggaggatggaagggtagaaaaagaaaaaaagaaaaaaaaaaaagaatgagcctttagaatataaaccctcgcccatggttttcgttgtgctccgactgaaatacaccccccccctgtgcctgacaatcaaacaattatggacctcgtttattttttttttactaattttccttgatccagcgatggcccatagactctccacctgctgtggataaggctataaggctcctctcctcagtcctcgctctgccctcgttctctctttttcatttcccttttctctgtgtctctctggcttgctcatttgctgcattcctcttcttttctttcctcttctcttcttctccttctctccttctctccttctctccttctctctctcactcattctctctctctcttgttctccatccgctctctgcatcctgcacactctttcattgccctttattgcccctcattgccttcattgtccccatcctcattgcatcgctgcttcaactgcatagtctttccttctctgtcgtcgtctgttcgtcacttgtcctttcgaccctggctcttcttcctctggatccaaacaccccacagcacagatacacacccacgcacacacagctagtgccacgccatggtcaacagtcgctcctccaccccttcccatcgcacccagcgggccctgagcatggctgcagacaccaggaagccaagagatctcctctccatctcacccgagtatccctacgtcaaccccttcgccaccagctgtccctcggtccccgcagtgcccacagtccccaccgtgcccgttctacccgcctcctatgtcgcccaacccccctcccctcgacacgaactcctcttcactgatctcgagcactttcaacgcaccaaaccccccatggccgagcacaaaaaggaggcccagatcgcacaacggcagcggcgcgagcagatcgtgctcatgctccagcagcagcagcttgaggcccaggaaaaggccaagctcgagaagcaagagcgccaacaggccaagcaggagcgaaaacagaggaggagcgaatacaagcagttgtatcgggaacagtacgagggtgccagccagccaaaggacctacacaagcaacattcccaacccattaatgcatatacccacgaacccagcagtccacacttccatcccagtcatcactaccatttggactctcagcagcacgagggcaactgctcgtcgtcctcctctacaaactcaagatcctcgcggacgacgcccgaccgggtgcgttctctgagtctcaagagcaacgcaaagtcaatgtctgacctgcgaccctcgcactcgaatgaatactactacaacggctacgaaagtgacgagaacaccctcacgcgctcgcacgactgggactcgctgatggacacgctgcattctcccacactctcgtcccccacagactctctgcaatgggaggaacctgagcaggatctcatggactcgatgaacggtttgacgctgtcaaacggcaatggaaacggcaaatacttgttgggtaagaaggttcactccaacaaacaccatgtgcactcccccactttgcggtctccacgccttccactaccatcctccccagctcgcgcggtttgtttcgttttgttgtgatgcattgtgtctcttcgccccgtcttctttccttggcacccacttttgcacctcgttgttgttgttccaaagtgctcactgctccgcacttttttctgcgcgttaccgttacgtgtggtgtgcggtattgtgtgacaaatacacgttctgggtacactgcgccggttaatgtacatttgtcagaccacggggtccaacctggcctgcggccaacagttctttggggatggtgaaatatttttcgttgcctacgcccaaaaggttgcctcccatccgccgtgctgggccattggcgaatcttcgtccttgcatgcaatcagtttattgtcacaccatcaccaccaccccctgcttgctgtcgatcgtccatatgttcatattaagctctactaatgcagttgcctccctctccattttctccctctcacacataccttttcagtcttgggcgccaatggtcggacaggcattgaactggtgaagcagggtttggaaagaaactaccgggtcactgcctttgttcgagatgacaagctacttcttgaggaaagctcattgcgcaagaaccacaatttgcttatcgtcaagggctcgccaacgtctcaagcagacctagaccgatgtgtcgaaggtcaggatgtcgtggttaacgtgatcggggtaagcgtcgttctttctttttttttttttttgtgcgcagagtcgagggattttctgttgctctcatacatagctccgcccgtaaagtccacttttgcatgcaaaacgtttaaccatcgtacctgctcttaaatttatacgtggatgctcactcttaggctcgactcatggccagcgatgctaccattggatcacactcgcaagtggtattgaataatgcactaaaaaagcatggtaggcaaactctcttgcaaggtcccgtttcgtcaaaatgccgaccatggtcagccatgaagtatggtttgctaataatagacacgcatttgattttctttttgttgcgtccttcgcaggtgtgaggcgattgattgttgtcacctcttatggatgccatggtctacgcaactatcttgccatgacccgaaagctcttttcccgtgtgtttatgaccgggatcctcaaggacaaggttttgcaagaggacatcatccagcgggaaacagagtcctttgattggaccatagtgaggcccgtcacgctcagggacggcgagctgtctgaacgctactgggtgtgctgtgaagaactaccaaaaaccaaggtcaagatgctgacgcgtaaggatctggcgcactacatcctaaccatcatcaaccggccacaagagtacaaaaagattcggagcattgcaggaaagaaggccagcgctggtaagcctggcacgatctgtaaagcaacataagttgttcgttcattttagtttcttcgcgcatccccacacatctttttttcccctcctctgcctgtattgcattgaacaactaccgtactttcttgccgtcacttttatcatcttgtcattaatagcactttccctgtaataaatgtaccatgtcaatactacggaggtctgttctgacgcgacgtgtgaagttgttggggcggacgcttaggctttgactgggcaggccccaatctcgatctactaaatccagccgcgcctgaaagcgacaaccatgatcaaagacatcacgttgttgtgagttccaattcgtttggccatgggatgctcttgggccgcgtcgcgaattacaacccatcccctgaaaaaaagaaaaacgagacataactgccttccacggaggtccctcgacttttctgatgctgagtaaacatgtcgatctcgcggtgtgcctacaaaccaaaattagccgagcgtacgcatatgcagaaaggtcgcacagggcacattagtcgagacaaaattgcccaggaatgtattgctgatctatgcttcatgtgttcatcgcagatttggtcagtaagcaaaaaaataaggcatcgatggcgatgcagccacatgtcgtaatacgatgggaaagctcacgaacttgctgtgcctttcttgacgactacgcatcaccaaatagacatcgagggcgaagccttctgttgttcgatcagaagagaactaacgacaactctcttctcactgcaatcatctaaagttctcgtccttcttggctccagtttattcgtccttttttgcacccctcacctcacccatcgactgcgcgaagcctccaagcttgcgttttcttttacgtctttctttcgttgaacatcctgccaacttgcaaaactcaccactgaaaccataacagagtggaacatttacgagcccaaacacccgcccaccgtctactgcagcaacatggatcccagcattcagctcgcagattgggcgcgtttaaagaaaaggcaccagcggctgttgatcagacggatccaaagcgatatcattgccgcaccatggatagcgaaccctccgtttggcaagaaaaagtccatctacaccgatttcttcgcgtcctcgaaacctctgaaaaagtttgagtccatcatgatccagcaggtcttgcccttctatgccaacactcacacctcgactacatcgacgtccaaggtgacctctcatagcgtgaagttggcacgggagaccatcgctcgctgcacccgcacgaacaccgagccaggccatgaacacgaggcggcggtcatcttttgtgggtaaggataacctctctctcatcacttcgtttccgcctttgctttgcaacaaacaccaccatgctcttctttttcgcatacctctcctttgtttggtgctcttgtcggttcattgcgacgtgatgatggtgagaggctgggatgttctattttcttcctcgtttgtgtgctctgcgtcttttcattctgcgtaacttgaccttcgtggggtagatagatccgatgcggcatgatcgtgagcacaaacatcatgaacaaaatttggccttttttttccgcggacagcgggctggggaaaagtgatgctagcacaacaaaaaacaaaaaaaagaaagcgttcactgactctccttctgcattatctcatacaactcaatcccttccactgcgctctctctctctcgtcggctcatcccctccggccgtctcttgatttgtcattagagatggctcaacctctggaatcaacaaggtccggaatgtatttcgattaagcgacgaggctttctggtcacgaagggcacacgccgcctcctcagccccacctgagattggcccgtcgtccactgccttgtccgtcacctcgtctattactcacagcccattgcccccaaagcaccgccccgtggtctttctctccattcaagagcatcattcaaatcttttgccctggcgagagagctgtgcagatgtggttgtgattcccgaggatgggacccatcgactggatctacgggtgcttgagcagcaactgattgagcattgcgatcgaccgctcaaaatcggcacattctctgcaggaagcaatctcacaggagtactggtaatgtcatccttcgagccgttgtggtttttttgccacttgatatgcattggcctatttttttttctttcaactgagttacttagagctttaaagcagggtgggggggatgtgtgtgtgttgtgcatgagtgtgcatgcgtgtgtgttttttttggcgccttttgtcagcctcatgcctcatgcatgcttgcttaggctagcacgctaccatgtatccccgactttttgttcatatcgtttatccggatagatcggtggtcactcttaaagatgagaacggtcaacgctctaacacaacctactccgtatatttagaacgacactgtcgccatcgctgagctcctacaccgacatgacgcttatgcctttttcgactatgcaggggtggggccttacactactattgatatgaatcccgcgtcgtcatccaattcacaccctgacgaacctaatctcgcctacaaggacggcgtcttcctttccactcacaaatttctgggcggacccggatcctcgggagtgctcatcgcccgtgtcgagatcttttcgtgggcagaccgaaacggagtccatcctcaccaccagagggggcatgcatacttcgcaccaccagtccagccaggcggaggaactgtcgatatggtgattcatggcaaacacaagtattcgagcagcgtgatagccagagaagaggctggaacccccaacatcctggcgaccatccggacagggcttgtgtttcaactgcaagagatcgtggacccggcctgggttcttgaaaaagaatataggctggcgaaaacggtgatggccagactcgccgctccaggtcttgcaggggccatccatgtgctcggtgcttcctcagaggagcaagataggattgcagtcttcagtttgacggtcaccgttcctccatccatgacccgcagcaagattgcacatctaccaccaccaccgcaggatcaaggcacggcggtaaaagacaacaacagtccgccgttgcagatccattacgcgctcctgagcacgatcatgaacgattttttcggaatcgagatgcgaggcggttgcatgtgtgcaggaccttatgcctccaaacttctgcagtttgacgccgtcaaggaggccatgttctggaacctcctcatgggccaggacctgaataataatgatgatgatggcaatgaagatcgagcccatcatcggcagcaccagcaccagcaccggcagcgagatctgagctcgaaaagcctcaaacctggatttgttcgactcagtttctcgtactttgcacgcaacaaggacgttgaattcgtgcttcaatcattggaatgggtggcccagtacggctacctgctggtgcctctctacaccctcaacgcccactccggagagtggactacgcgtcaagccgtccgccaggccgtctctgcagaaatctcgcccatccatgccaggtgcggatcgcgggaacactgtatccccacggcggtcgattgtatctatggcctcaaaaaactctttcaagagcaggattcgttcttgtccaggtcatcgaacgataacgcggtccctgatccgcctcgaatgggacaagaagtttttctgcacactcaaaacagcagcagcaccagcaatggcatctatggcgccggagtgttcgcatcggtcgctcaagcacgaaggtcgctgagcaacgttctttcggacgtgttgagtcgacccaccagaagcagccacgcacgcgttcactcgaccgcgccaccccgaatgcagagtgacgccgtatccatgaccatgcgcgacgaccacgaactggccgtgcttggcgattcttcaatcttctcttcgagttctgaatattcctccatgaactctggcttcagcgcagctgctgcgacccggcagattcacaacccacagcaaggcacagctgctgttgctttgtccccctcctcctcctcttcctctacctcctccttctccttgtcactaaatccaagcagtggcggcggcggcagggatcccgtaaccaccaagcgggtcatcaagaagagtcggctgggactcttctctgtgcagcgacgcagcatctcaacatcgaaacggcaactgctaaagcaggcactagaggaactcgaagccgacactttgcagagagaagtcagcgcggtcgagactagtccactggccaaggagctgaggtggtttgtgatgccttgggaagtggcacaggtgtataagcggcatctagcgtatccttcagatgtttcgtctccgttcccgaagcggaagtagactgtagtaataaaggaaataaaaccatgcttttcggactcttaaagcctgcgcctcccaggccagatgcgatttttttcccctccccctgcttctgaagcacaaaacaggaggggggcaccatgatttatatgcttgaataacgggaggagtcgatgttgaaggttcctacggacgatatggctgatggagaattatcagagatgggctgtgaagactgcggaacgaccgggacatgaggggtcggctgctgccgcactgttatcgggctccatgttccagcgacaggaagtgtatttaagcgactctgttcttgttgatgtcgctgtcgcggtggtggtggcggtggcggtgttggtggtggatgcgcagacgcctgataactcttccttgaacggttggctggtggaaaggtatttctccctgagaacgcgctctgttggtctccatgatccgacgaaccctgcgatacccgtggtgacggaccctctgagccatgaagtgtcgatacgctaggtgtgaaggagaactctcgctgacgctgcgcctgagcattcgagctggagaatgaggccacggacatggacccttgatgcgagacctggtcttgacatagaagtccagcttctaggtcttgctgctgtcgatgcctctgttgcccttccacctgctgctgctgctgctgctgctgctgctgttgatattgatgatgctgtcgaagtagacactccggatgctcaggatcttcagtgtagtaaaaatacccgccatcctgacttgtgggacggtattcatgtccgccgtcgctgtacaggggtgacatggggtgccttccgtgcagcttgtgatcatcctgcgaaagatgctcgtgatgaccttgatgatgtggcccgcgacccgtcataaatggcatacgcttcttcttgagttgatggtccgagaatggtccgccggtgatggggaagggcatggggatggacatacccgagatgagctccgactgcatatcgtgctgcttccgtacgagctcaatctctctgtctatggagggttccttccacctcagcgccgaggccatcaaaatcagaatggacgcgatcgcaatgatggccatattcctaggagaatgataaatggttttagaacgagttggacatcatcaaaaaaaaaaacccccccttttgtgtgccattattctcaccagtaaaatccaagtacatcggctgcacaaccgatcgccggaatgccgggctgtgtctccctcaaggcgggcaaggcgaataaagtcgtgattccaagggtgaggacatgctcatcggagaccctgtactttctaatgacctgaatcgcaatgatgccgatggagatgctgaggcaccacatgatcatgacaataaacagactaaagccgatggtggtaggcgaccgtcgcgtaaagatctcgatcgcaattttgtacaagtcttcgttcgataggcgtacagtcgggatgaactcgaccgattgcagcattcctagaaacgttagactgacggggaccttgtgcagctgttctttctccaggttggccatgatctcgaaatagctcttgtaggcatcaaatggatagtcaatggtcgctccttgcatatatggcatggtgacatcgaccgagcgcctaagaaaaaaacgccaagtttttagctgtttgaacaggccgcagcacaaaacaattttttgatcaaagaatctcatacatgatctgtgcctcgggaaaggtcaatgtcgtatagaacagggacactgagatggcggccgtgagtacaccatcgtcacccgtcaaggttccatgaggcgtgaactcaaagtgtacacgaaagttcttatcctcaaagtcgacactggccacactaccgacaacgtggataaaatcgcctgtgtgtgagacgccctggggaccgacctcaaccacagaacgagcgttatcaccctcacgacggtaaatggaaaaaattggaatgacgaccgcgcaaagagatccggtgacaacaaggctccaaatcgttcgtcgagcccaagttctgagctgtcctgttttctcatggaatagtgtcatggtgccgttttctcgattggtctctaattgtgcctgggcggctcgaccttgattctcaagcgagccagcgctcgagaagggtcaggggatgggggagacgtatggtcgtaagttctaggcggttgtagggagttcctggagtcagaagatgcctggaagtgcaaagattgtgacaaggcgcatcaaaaggaagaggagaactaggcggagaagaaagaggaggaggaggtgaaccgttgctgaacacgagcgaggaaggaagagtaaagaacagcattaaatcatcctgcagtatagtcatgcgatctctacattacttcgatggtattctggtcatgctctgagcgagagttgcttagtctcgcgactcttttctctctcgtcctaaggacgagacagtaacgagtggtttgatcagccgccgcggtaaattgcgagcgaacgagcgatacaacgacgaagcagacgacagccctttgccttgtttgtcgccatggtgccacaggcacttacacagacctcgtcggctcgctgcatccgtttactaccatgcagcattccaactttttcaaaatcagcaattcttttatttacatttttttttcttttggcaaatgttacaatgaatgaaaggtagatgaagtgtgtgagggatgggaatgtgaaggagtggggtggggggttagataaacatacaaaacaagtacaaagataaaaaaaaagtaagggaaaaaaaataatcgcgcacagactagtaaccacgagcgacagcgctatcggtagcaagcttgctgtgatccaacaaaaagatgtcaagatcttgccaaccaccacctacacggaccaagacctttctagccctcttcttgctgctcgaatacgtgtcctcttcagcctgaagggccgcaagactgcctgccgaatggatggtgggcaatccagacgggttccttctcgtcatttgaatttttgagcggccagaagctgacaggccatcatcagtgccgctatggctaccaccgctcgacacgccagaatcatcgtctccggagcccacacggccatactccatcaatcgacagagcaccagcttgcccccgacaagggtctgatcctggactcggccaccaaagtagtatttacccgcgcccaatctgcgaatctgcatttgaacggggctggcgttagcaactctcgcgaactcttcgtcaagctcgtcaccgcgaatggcggcataaggctcgatgtcctcgatgtggatcttgtccatcagttctggcataccttggtcgcggctataagaacgctggtactgttgctgacgaatggacgacgtgtaggacgacgaggacgaggccgaggggctggttggctcatcataggacgcgtactggtacgaatctcgtcccataccggtgcctgacgcagaccctgggcgcgagctgtaagaggcatactgagcacggtcgtctgggtatccgtactggctctgtcgcgaggacggctgacgagctgctccaggggaggagcgtccttcatgagcaccatatccagagtgcacttgaccattagcgctgagctgtctctgacgacccgacgaggacgacactgatgagaccgagctgcgcggagaggcggcgtagtttgtcgggaccggggatgtaaacccacgcgactgaggtctctgagactggggcgtggggctgaaggcagagcgctgctgttgactcgaggtaggtcgagacgaggagggcatcggcagctgtgtcctgcgagctccaccagaagctggcgttggcgaaggcgttgagacgggcgagcgcacgccgctggaaagcttgctgatacttccggcgggagagaacaccggcttgtactgagaagaaccaggcctagacatggcaggtgtgctagcattggacctggagccaccagacagggcagaaccagcgcgacccgtgggtgcaggtgtctccatgcggttttgtcctgcaactgagacgggacgagggataaatgttgcggccgctgagagttcttgtggaataccaggaattcccggtgatgttactgagacagaagggcacctatttgagcaagaaacataagtatcagtgcttccgtaaaaacaaagcgatacatggattcaagtttgaatttgcactgccattaccatggacggaagcggtatgatcctctggtaggggatctcgtagggctggggctcagcgagcgatagttattcagggcactgggagacagaaagccagactgggacagtccactgttagagttggcaggcgaccaagggcggtagccgtaatagtctccattcggggatcgcgtccttgaacggcctggagatggggagggcgaacgcagcgatgccgatggtggtgcccgtcctcgctgaacctggctggtctgttgctgacgttgatgctgttgctgtcgtggctgctgttgtctttgttgcattggagacggtgtggcagtagagttccagccaggcttcgtgttctgagcacgcttggcggccatacccgttggctcctgcttcttcagaggcagcttaggtagatagggcgtcctaagatcgtcaagaatgtccagccacctctcgacgccgtcaagttccctgtcgacatgttcgaggccatcctgaagtttgtcccatttgatgttcattgcctggtgcctcgagatcacatccatgttgcgagtcatgcgactctcgatgccattctccaacatgtcgagcatcttgttgacagcgggagtgtagtacttgtgcttggcctcaaaggacttgaagatgctgtacaggtggtctcgatcaatgggtgcatcgggggcaattttttgacggaccatacccttgatttgttccaccaggccttgacagtggaggatggcccgctccatggaatccatcattgactccacctgctcagacacctgctcaaagacctcgagccaacggtcctccttgagctcctcgctgacacgttctcggcggaacttaaggtcgtcccagcggcataggacttgctgataccggctctgaagagcgtccttagagtcactgcccagactgccctcatccgtaggcagggaaccaacgcggttgtctagaaaatcgattctggagatcagaagctcgatcctagagtccacttgagccaaggtctcaaggctgcgctgcttagcctgcgcctcggcatcgctggatgaggccttgcttggaaggagaccttcttcgtccgaagtcatggcacttcgctcgttgttgtaagcatcgatgctcgtgcaaatgtcctcgatatctgtcagcacattgttcatatgtgtcaacagctccgcacggagtcttgcaccggcgaggtcgcccttgactttctcgagcatttgcttgagcgaggtccaacttgacttgataccggcagcggtctgcttaaggtcctgctcgatttgtagcgactcgacctcttcttgttccgcaggcgtggcagccttgagtctggactcgatcttctccctgagctctacgagcatgtcgatgttgggctggaaccggttcatgatgacatccatgtccccgacgtcgcgcttgtctgtagctccctcctggcccacatccatttcgagagcaaagacggccatctccgcactttcgagccaagtggtcaagtctgttgcagctttgctgaagcgttcatggagtgttgtgagaggaatggtatcgtgtgaggagagtgcatggtagatatcgctgtagggtactggcagccgtttcaagttttcgatctgagattggtaagactggtagagggtgttttttgatgccgttgctgctgttgctgcttccacgggggccgagttgtcgggcgaaggaggagcagttggcatctgctgtatactgtcttgagataatgacatgatggctgcagatatatgaggtatataaataacactaacgagtgcttctaatcatttgatatacagacgagagcaagagaacaaatcagtatctgtttctagccgtaaaaggatgcacagagcatctagtgatgaatgttgcttatgactctgagcatcggtatgaataaaaaagagtaggcaaaaagagtaggcgcgaaggggaaagttgcatggaggtgggccgcaaaggaatgactgacgggaaaaaatgaaggttgggacgcgtgctgtttcagtcgcgcacagtgttgtccaatgacggtcagagtcacacaccgctcaggcaccagctgcacccgagcgcagatgggagctgcagtgtacccatgccaaacaggtgtttgtccaacagataagcccaagggagcgtctgccagcaaagcgcaaaggccagccgtttcacactatacaccctacatacacatacacatgatcgccccttcttccagcagccattgtcatatgcaaatacaaactcagcgtgctgatgagacgagcagtttaaggcgatggcgattataagggaggcaggggagggggtgaaagagaagggagagggaaaaacatagggagggagcggtgggaacgacggaagagatgtcacagcatgtggtgcggaacgggacaaggggtgggaggttgagaagtgtagtcagtcacctatcgcacatgtgcgataggtccatacgaactggtgtgtaagcgtaaatgtgtttgccctgcttatcgcgcagagaatgagaggcatggaaacagaaagggaggcaggatgatcgagaagagatggcgagatatgcaccgctgaaggctatgaagtgcgacaacgggcatcgctatctcctgttgtatttcggtcctcttgcgcaactgccaagtctgttctctggacctgcgccactcctttcctcgatgcgccgccccttcgagcgtctctttagtgagctaccataaccctccgactcaccttgagtgtaatctcgagctggttgacgccacgagcgaggagctttttgtgggtacgagtgaatgggtatagcgcaatgaaaggtggatgctgtcgttgctgagtgctgcgggttgaatgtgcgttagctagacggcacgaagagctgcgagattgaagaagagggtgttgagcgtgagtgggtgagaacgtgaggcgaggggttgctgggaagagctgatggtgagtgtggaacggagagagaatgcgagagcgagagcaagagaagagagtcaatgagagtgagcaaggaaggagcgaaacaaaacgagagagcaaaagagagtgagagtgcgagtgataagacaaaaaagttatattaaaaacgaagagacggctacgctggagggctttttcttttttttctttcgttcgcgcaacacatgggtggtgtcttactgcaattcagcatgcccgagggcattcctacgagatacgaggtactcgccaagggcggcatcggataagcatagttatgggcgggatggcattttcgtattgtaagcaatacaaacaggcccaacactacacaacaaaagggcagcgtgcccatggccatggtggcatatgacggacagactccctcggcctgggctgcctttgaattgggttcaattcactcactaagggttgtctggtgagcattggcatatgacagtcatcctcacgacccatgggcaatgctgggaataaacaaacgcagcccttgctcctcaacgtgcgctgcacagttaccagtgctgcagatgcgtcagacccaacccccaccccccatcgcccatcttcgcctttcttgtccatcaagaagcaccatggccgtttttgtgcaaagtgagcactaaatcccgcaatgcgctctgcaccgcagagttgcgtgtgttgaacatggacgctgctgatgctgacttgagcgagtgcctcgagagctccttttctctcctttctcagtgtgccaacgtgtcaactacttgccacgccgcgtttcactgcaatgtctctgatcatagaacacaatgttccgcaggtcctgatggctccccgaacctggcaccaagagaaataggcgcatctttttttttttctaaaaattcgcactgcatctcttctgctgcatcgatttcttcccatccaatagcccactgtccatggtccatgccatagtgtttgttagactgtacatacacttatcgatgcatcggtccagagtccacgaagggacgcccaaacaaataaaaaaaaaagagaacgcgatattgttattgcacctcaagctagaaagcatggcgcgtttcttttttgatcaccgcccaagaaaaaaattgtctgacaaacggccattctgaatcaattgtcgctctcacgatgcacccaccaaaaactgttgccagcaacaacaaaaaagaccaagagagcgcgtagactagtcgattgcgttgatatgtcaacggaggcttcaatggcggttgtgcctgcaaagcacagaacagaagggaatgcacttgctcacatctttcactaatttagtagtttgataacgtagctaagcaaggtcagacggagtgtgccgcgcaatgcaaatattatccgatcaaggagcgcaaagccaactggaatgaaaaaagtgatgcatggatatagctgagttacaaactgcttcgcatatgcccctcggcggtgatgctcgggcagtccagccttcacactctgaatcgccaagcctgtgagatccgcggcgctgtgtggagacgaagaccaggctagtatgtgatgacaataaaataggttttttttagcccacaccctggtgaagactagaattaaccctatcattacggagatcattaggtgaaagactgtggacgccaactgaaagcgttttttcttcattcaaccacaccgtcgtgatcggtatcgaggcatggattgccattcattggcgaaaattagaaacatgttcttgctgccatctcacatcaacatatgtgtcaagtcatcaccgcgagaaaaggcgggaagatcatccccagtcgattcacggcataaacacgcgctcacagaacaattcagcgcaaaacgcaaaccatgactcgctcaagcatccttgcactagcaaccagcccctttttgccacttgggacacagcgtgtcaacaaaaaaaaagagaaacaaatgcgcgcatgataccactgtgcaccaacgtcgcaaacttttaggggagagtatgccatcatcgaacaaagagagagagagcgagagggagaaaaaaaaagagcggcgaaaaccacatagacgatccctgccagagtaaacgggctacctatgaaatggaagatagagacgacacaaccaattctgaccagcggtggccattgttagtgcagtgtggtctgaaagggggtatgcagcaggaattgtctgcgttatgcaaacaggtcgacagggtctttccaagctactcatgtcgtgtttgatgtgttttgttctcctatcgctggaaccatgtgaatagatcttttttttccagcgattctcgcttggcccataacgtggctctgtgccatggtctgccgaagtaagatcatccttacgcagtggcgaccttcgagtggttaatcagctctacacaactagggcgtttctcgcatatgccccatctgcgaagacagtgggccaaacttcccgctgcatgacccacgagaagcttcttgaggagctcgcacgctgcaaaaaaactgctccccccccctccccttcatcctactactcacagacagacacaaatgtccgcgatgatgagtgattcttacctttagacacaaacgcctactcgataatgtcttgtgggttctggtccataaacgcggcagcactgatccattgttacttgtcaagctggctgagttttttctctgaaggaaataggccgtggaaattggcgttaagggtcgcgccaattccagttggatatatcgcacggcctgccaggcagcggaagctcctcctttcacttcccatcatggaaagtatatttagtccggggaggagagatccatctgggctctgggaggcgccacagcacccatccatcgcccatcaccatcgcgccagatccatcgatccattcagtagtcgggacaatcgctcaagcatcgccatccgtgtgtctactcatcgcatgcaccaccacaactaccccaccgctacaggataggcagagtccgacccttggagcccgtggcaaagaactcgcatgcaggaaccagcagcaaatcggacaatgcaaacgacctgcttgtgcgattgaagcgttgaccagaaccagctcagaagacacttaacgaggggaatccatcgtcttggatcacagcggatcgtcgagcaatcgtttgtgtcaatcaatcccgaggggcgaacgcttcgagtcttccatccgctgcccaggagtgaacatcgtaatgctctggagacatgcggaggaggacctcgggatcgccgttctgggtctgagagaccgaggacctcgccgtcagcttagggatgatggattgacagcatgacctggattcaccgctacctgaggacaggatgaacatcaggatctctcatcaggccttctatctcgtccattgtatgccgcatacttaccagcaacccctttctcttacctcgacccaacagaccttcaagagaagaaaccacggacgcaacaagaacggtcgtggccacgttaagcccgtccgctgctccaactgctctcgctgcgtccccaaggacaaggccatcaagcgctacaccgtccgccccatggtcgagttggctgccgtccgtgatatcactgaggctcttgtctacaagggtaaggagatcgacttttttcctatttttttggtggatcaaatacgtcagcgacaccaaaggccttcttccttcgacacactggacacatcaacggcggacagatcgaagcagcatcggctgtttagaaatgtatcgaaaaggaattggcgacgttttggagaagatctgaagggcgccatctcctgagtctgttaaaccacctgtcaagcacattcactaatatattgactcgcttgttgtctttcttacagagtacaccttgcccaagttctacatcaagattcactactgcatctcctgcgccgtccacgctcacattgtccgtgttcgctcccgcgttggtcgtcgcagccgtgctcctccacctcgcttccgcttcaaggtaaagatcgcagtgatgaacaagcagtggtaatcctcaaatgttcccttcgccaaagactacagccactaacccctgtctccatgtctttcatgtcatataggatggcaagaaggttgcccctgcccaggttgccaagcctctgtaaagtgatcgccggtgccccactagcgctgacttgctgaaaaataaacgattcagaacgagaggagactctttgcatggtcaagtgttttgaaaaaacagcaacagggcacactttgtgtacttgtctcatacgcgcaggggatatgtgagccgatccagcattgcccaagcaaagcaacccgggcctattgatatctcacagcatcccctgtgtcctcaaaaaacgaaaaaaggggggcaaggctgagaatgatcgcatctgctgcgtctctgatcaagggtccttttgaagttctgtgcgggggttttctctttgtcttccatacccatcgccattactcattctctcaccaccaacccgtccgcattccaagcactacacccattcctctcaagctcatcccgtggactgcagacctctagcaagcacagacttagtagagacatacagacgcagacaagcacacagtaccaccagccgcttgttcggagcagagctacaactacacttgaacgcacgtcgtcggcctcttgcgaacacttccccgggatcgttctctcctatcgaaacacgcttgtctgaaccatgaacctgtttcgtctggtcgccgacctgatgcatcttgcgtcgatctttatccttctcttaaagatgcaaaagacacggtctgttgccggtatgcgacctcttttttttttttttgttgtactgcccattctccatcattcgtcgatatgatgcaatgtactctgcaatgtggtttcaaaggccagccatcaaaccgttaacgaggggaaacttaactttcaaacctaggcatatcgttcaaaacccaggccttgtacgcgactgtcttcttgacacggtacaccgacattgggaactttatctccctctacaacacagccatgaaggtgttcttcgtcggatcctcactgtacattgtgtatctcatgaagatcaagttcaaggccacaaacgatcctcgcttggacacgtttcaggttcagtacatcgtcggtggtgcagcagccctatccttggtcgccaactacgcattcacagtccaggaggtaagcgatcaacaaaaaactgcaagtctcacggaccattaccataaaacaaaaaaaggacgcatgcgcccgcgactattttaacccaaaccatgtattttgcctcttttttttttctttcagatcctgtggacattctcagtttacctggaagcggtcgccatcctgcctcagttgttcatgctgaccaagacaggagaggccgagaccattaccacccactatttatttgctctcggcgcttaccgtggactgtaccttgtgaattgggtgtaccgctacttcaccgagtactatgtcgactggatcgtctggatcgcaggagcagtacagacaggcctctactgcgactttttcttcatctacttcacaaagtaagtactgtacacgtatttttagtcgttttttgggtgcccttctcagcggggctatgaaaacgacagttacacagagcagaactcgggctaatgataagcgtatggatataccttgatgcgaaatgtagggtcctgaaaggcgccaaatttgagcttcctcagtaggacagcaacattgaaacaggagtatatacagaggatgatcaaaataaagccacaacagccaagcccgcctggccattatataaacaacacgaaagatgtcggggtaagaactgagtggagcaacctccaagggatggtgttcaattttaatacaagggaacgagtgatgcataaccagatgtgaacatgctgaagtgtgcgactcgatgactcgatacatattgctaatggtggatgggaaatgtcctaaaagtacaggagcaattttgaggaatgtgtagtatgtgcaaggcgaggaacaacgaaagagtaaaaaaagaaaaaaaaagaagggtctataggtggctcgcgaaaacgaaaaagtcgaggcgtttgtcacaaaccagggcaggccgtctactgtgaatgattgttgtgaccgatggagatgaagtgatgtctggtagatgtcgaaagacttctgagatccgtctcggataacaaggtacagcggtaacgtatcattctatcgattacgcaacgatacaacattcgcgcgttagtatcggtagccaaaatgcattgtacgagcagtttggcaagggtcaacgaagacaacgacttacccatcgcgaagatcgtccacgatatcatcttgatcatacgagtcgtcatcgaaccgaaacttgtcgaacgtgttgatgttgtcgtactgtccaaatagctccttctgatacgaggccatagcaggggacagctggcgatcgatatgaatgcgcccaccacgacccatgcgcttccggattgacacatacttggcatttcgttgagggggcagcagcttgaagcactgctgcgagtagggcactgggaagtgttggtagggattctatgtatcatataaacaattggaagcggttagaaacagatccttccaagtctggtgatggcgtcaaaggttaaaagtcagccttgaacatacgtctgtaagatcctcccagccaacgtcttcctctctgcgcttggcgagctccgattcgatgcttgacagacccatacgatcctttctgtcgtcctgagagccgttggcctctctgtccttgaagttgagtggaatacgaatagtagcgctcgtctctccaatctttctgatctttttctataaacgatccaattccgcacgaaaaggaaccgttagcatcgttgatagactttctctttctcattctcctgcgcaggaggtttcttaccttctgatcccgaagatcgtcgtcctcgtccttaatacccaagtttcgtttaagctcgcgcacagtgcaccgcttatcaaagatggtgtgttcaaggaccaaggactccctccggactttctcacgtcgagagaccatctcgctggggtaccaacgacaacggaatcatggtcccactcctcacatcccaagatctcggcaatctcatcgactcgatagcacgtctcgggatccataccggccttgttcgcaaagactaccactggtatatctttgcgcttgaaatggttatcggcgatcaaggaggctaggaaatgacgtgcgttcacgagatgatccatcccacgaggatcgttcttacgggtcgcgtccacgacatagatgatcccatgagcgaacggaaaccaaaaggtttgcgccaaggttcggggcacgggccaggtggtatcgagcgagaacgcgtgcacggatagagacgcatgcgcagaagagttcacgtcgggcttgttagcgaggatgggctctgaaacggctgtgaatgcggactcgctcgataaccgctgctgcggctgttctatttgttcagcctccagctcctttttcgaggagccttcttcgtccaagtcgctgagaatgatctcttcacggtccagatccaggttcacggtgctgttttcgctgctgccactgttgccactgttggtactgctgttgctgctagtgctgctactgagactgtggtggctacccgctctagcaatcatctgttcctctggcgagccctttgatggcgacaataaggcctcttccttcttcaacgaagctgttactgcattgctgtttgcgtcgtcttgcgcaacatcaccagccaggattgtcccctcggcgagagcagttgtctctgcctggagagacttcttccttcccatctcctccgtcatctcatccgtatcctggatcgaagcccttcgactcttgacctcatcaataccttgcctcgtcaaaaacgattcaagctcttgatctctcgcggacggcagggccttcgttaaaggagcagcactgctgcacgaaaacgatccgctcgatcgaaaataggccacaaagaatcctgaaatttcttggtaatgccggatcttggacgccgcaggcagcaggctggacatcttgtacaacgtactcgccaacggtgcagagtctgaccccaaaaccaagatattgtagtgtgggggacctttcactgttgggctggacactcgagacgattgcgaggacgtcggggagaggagttgtccaagactcatcatgccgcttttgagcgactgtgcaaacgatcgacgcttctggagcttaggtgtggggttggttgtcgtgggcgaggttgttgttgttgttgttgtcgtcgtcgtagcattaacagcagcggtggcagccgtcgcagaagtcgtcagtgcattggacagggaagaaggggtcaaaggactaggagggagcgaactcgacatcatcgtcatcatatggcttgtggaggcagcatccgtggaatggcggcctttcaagcctggaatctcatgcttctgtcctgcgaggatggcgtctgctgccaaactcggtcgcctgttggcgttcggaaactggccaaaggacggtgagatgggcgaaagaggctggggcgaaatgatctgcccgtcggcctctgcagaaagatctcggctgggtgttggagagaaaaaatcccagacgttctggcctgggaggagcctgttggcaatgatgtgggtgaaagagagaacctcgctggtggactggcgaggaagcagagggggcttcttatccaggaaggtctggggagggttcgggagggaggagggcgagtgcagtgctgccatggctgtatagttggagctgtttcgcctctattgagcttgcttttctttcgacgtgcggcgcggcgcgatccctggtggactgtgcggaaagagagcggcgcgtggaataaagtcgggcgcgctagtgcttgtcgtaaaactgctgcgagcaaaggtcagggaatggagacgaggaatgccacgtcggatggatggaggcggtggaccaggaatgggagcgaggggattgggaatgcggagaaaagggacgaaaaggagcagcgacagaaggcgcgaccctgtcctgccgtctaaaattcaattctattccaggtggacgcggaggagacggacgcgggcgcgcatgcacacacacacacacacacacacacgcacatacacgctcactctcgcgcacgtcagagaggtaggcagggcgcgcctccatcgccgctctgattctgtcttgctctgtccttacccttccctagccttccttggcctttcccttatcgatgccctcgtcggtcatggttaagcgtggcattttgagctctcgttcatttccggctagcctgggaatcgcattgcctgtcattgtcgtgtgtagtttgtccgcctccatcgtgcccacgctcgatcgacggtagtctagaggaaaatctcccacgactttgatctctgcgagcccaggagtgtgctttgacgtgaaaaatccagcatgtaccaaagcagggcagcattcctcattcacgtcgctcgaacaagagatacatgtactgtacatgtacatccatgcacaccgcacccccatccgctcctctttcgagcgcacacacccactctgaataataatagcgacagtggtagctcataataggtccatagcattggacagctgcatgcacagaccgcgtccggtaaagaggggcaacaagagtccggccgtgaaccacaatcccgtcagtgccccatgcacaattcatgagactaaagagatagacacacatgctgagaacgagataaggggggccaaggtaaaaacaaacatgacagagggaaagagaacaaggaggttaacaaaatggctgctattcgtgccattccccccctccctccttccgctcgttcatgtcaaagaaatgtgctccttacctgctttaggtttattgcgtttgtagccatgatattgttgtattcactcatcagctgtccagagatccagtcactgatgataaggatgacgacgtcgatgaggcgatggacgctcgacgagcagcaggactcttagttggaggacgacctctctttctctttgcagcaggcaacgcggcagccgcagcagcagcggcggcgtgcttgttcttcagggccgtaagctccataaccatcttgcggtcatactcaatccctgaaccgacaatctcaggcacgcccaacaacttgcgctggtgctccactaacccacgcacgcgcgtcgtgcctcccaggagaccacagaccttatcttgagcaggtgcctgaccgcggaggctctgcaacgccacatcctgatgtacattcgccacattaacacctgcaccaggacgaagcggcgtcaccttcagtgcgcatgggggacatgtgtacttgagactctcatccttacccatctcctccaccagttcctcggtcagttgaccgtcgcaatcaatgtgaacccagcgattgcattcgtcgcagcaaaccatattgttgtcgtcttcacctgcggtatcagactgagcgtcatcgtcggctccgtcgcccttgtacgtccgaatacaaaccgggcaatatcggcccttcttgaagttgtcgtgacacttcgagctattgtcataaaatgaattgtacaaacatcagattttgttctctcgtacatcttactccctctctgaacatttcacaaacataccagtatgtgcacagaaaagttggaaagcgattacttccagtggctccgacagacgtgtgcttgtatactgtgtttggatcctcgctccctctgcatgagtgacaaagcgcgcagaaagaacatagccattcgtctaaaagaaaaaaggatgtacagttagtgcataaactgttggccagttgcaagtaggagagtggtcttgagggcacatgtagaacagtcagcttggagcacataccctgaggaaccttttttatggcggggtcgcaacagctcatatgccagcctcggtcacagtcgtcgcagatgagcaacgaggcttcgtctccggcctccagacaaaccacacatagtttgcagtcgttgcactgccatggatatgatgcaatggccgagatgatcctgggcgtatccagttgtaagcacatggggtggaagccgttggagcaggtcttgcaccggttaagaaaagacgtggcgcagggcaaaggcttttctgtgggaagaattctcaaaggtactgtcgcctcgttacattcgccgcagaccgcctatggaacactcactcgttagattgagattttttgcaaaaattgcttttttatcatctgttcgcgttggccgtctcacctgtgactttccgttcgtcaacggagttcctggttgaccacctcgatggttaggacagtgctctccttgcgtactgacaagtcgctggcaatagcctagtcccgtctttaataaggctccgcatactattcctcctgactgaggctatggaggcaatttttcaagcaaggttaatggccaaaacctgaaaatcgaggacttcgaataatgcatcggcaaaaatataccagacttacaacgaccgattccgctctctttgcagcagctgcagcggcagccgcctgttgttcctgttcctgttgttgaagcttggcttgctgttgcaaaatctgctgctgctgcgcttgttgttgttgctgttgctgaagttgttgccactgaagcatgcgtatgtcctgagctgatgtttggcctggtagcgtagcttgctccatgatgggcgctgtttcgcctccggactgcacggtgtacaggtgatgaatatactgggcatggccggccatggacttcggtagtaccactctatatggctgctggaaacgagcttggtgactaagcgtatcataaaaggtgaccaggaaggggtgaggttcgaggcttcgactaaaagcgacaatactacacattgcgaacagagatacacgtacactggaaaggcagcttggaaatgtccgtccaaaattgagagcgggtactttgtgaggtcgacattctcttcatccttgggctttgacgcgtcagcatcctctaatgcctttcggatgtcctcaggaatgacggcccatatccttgggtcctggatgactgggggtgaaggggcggctccctttatctccaccttaacaacggcgtccacttgaggtccgatagaacgtggaatggacagaacatgagagattacgccgtttgctggttcggatgactgagtggttggtgtaggtactgctgcgacgctgcactgcgttggctgtgtcgaggatggtatttgctctatattcgtgtgcggatccataaactttgggttctccttacgcagaacttgaagctgcgagttcaaggcacggaccgccagtgcactttcgtaaagccagttcaggtctgtgacctggcgggtcgactcgtctgattgaagtaacgtgtgcttgcgctttcccaagaagccgccttgcttatcctctgcgtttccgttgatctgagacctcccgtcgtccgtcctagatgttccatcgtcatctgaatcctcggctggatcatcgtcagccgcaagcgactcatagtagtcatcgatccggtttttgcccttcttgatgatcctgtgtccaaaggatttgaagatcgagcgcgcagtcacgacggcgatgagtttcgacttgaagttggccatgagcatgcctttctcaatcatccatgttctctcctctacagtggtgttgactctaaccaactgaggattcttcaggaagaacagatagctgtctctgaagcccaggacacgcgcaggatccatcgacagcatatacactctttcgcctcgtgtcggcatcttgaagctcctgcacttgtattcccgacctagtgacaaaattgtaatagttgtcagatagctggagcaagacgattacggatatcccccggaaaagcttatttcaattatcttacctcctaagagttctccatccttggtgatctttgcttctccagcctcctcaatctcgccctcaatctcctccacatcctcaggcggctcctcctctttgaggtcgggaacagcattatcaacagctggctgcactgcctcgtcctcatcctcgtcgttgtcctcgccctctgattgtggttttgctggtggagtccgtgtaggtccattcctcgaaggcttttttgatcgcgttgggcgactggatcttttggctgtggcttctagctcctcgccattgtcgctctcctccgcttcttcttcgccatcctcctcatctgcaagctctgggttcgaagatgatttgccggctgatcggccttttctaccagtttccttgactgcgcccatggatgccacactggaacctctcgcatttggtctacgcgctctagagggcgaaggtggtgccatttccgtgtccgcgctcggtttggcgactgctgacctggaggactgtctagatgacgatgggcgaggtgccggtgatgatggatggcgcctggtgcgagagttccgcccacctgtggtggactcttgcgaatcagtcatctatagcggcgctgtatcggtgccttcacgtcagtggagggatcgaaaagaggagggatctgtatctctctgcgggaatactcgaattgggtagtggatatctagcccagatgcagcaaagacgtccgtgcggtctaacaactagggccacatacgaaaactgatcagtgcactattcacaatcgacattctctctctcagcagttgttggacgtgtctgcatgtctgcaacgctcagtctctgccctcgtgctgtctctccattatccccacgcgactttggagcaacgacagcggtcgattcgaacgggctgctttacgcttggaaggtggaatggggggcgttttcctctcctggcgcgtccactgtctgtctatatttgtattgccctaccttatagttgtcccgtgtaaattattttgatatttttggcgaaacgctcttttgcttctgcacctacttcacgacaaacacgcagcctaggttgcgcgtgattgggttgatcaaggggcgatccgctgagcgtgaattaggtgcaaatgcaaagcaggatgaagcgggcaattgggaagcctggaggcaacggtttaggcagctagaacagcggacgagccaaaggggaggagccgtgaatgggtgatagagagcgagaagtggagagagagatagagaaggtgtgagaaggagcagagagagagaaagagaaagaaaggagcgactgctgcagtggatgaaaacgcagccaggcgcagaggtgggattgacaaagaggagaaaaggcattagtactgattgtgtgcttcatttttgacttgtaggctcaagaaagccacttccacgtgacttatttgctgggtgaatttttttttatttgttcctttacaaacacgggctacgaatggctgtctcatcgcacagagagtgctgaagcgggagaaacgaaaaggagagaagagaagcgatccagggatattttgccaagagacacatatttccttcgtgaggaatgcgaccaatgcccgtgctttggggggcgaggagttctgacctgggaaggaaggccgttctgcgctcgctcggtcaacgtcaacgcgcttagaagcacttgcggtggacaatcgagggacccgactcgtcgtactccatcttggagatccacatctgctggaaggtcgacagggaggcgagaatcgatcctccgatccagacagagtacttacgctctgggggtgcaacaatcttgaccttcatcgagctgggggcaagggcggtgatctccttctgcatgcgatcggcaatgccggggtacatggtcgtaccgcccgacatgacaatgtttccgtacaggtcgcgacgaatatcaacatctcccttcatgatggagttataagtggtctcgtggataccaacaccttcaagacccaggagcgagggctggaaaagagcctcgggggcacggaagctgttacagaatgaaagacaatagaatcagtcctcgccgcacttagtgttgcgattgcgatcaaagccaaagcaaaacacaaagttaaggagagaaaaaaaatgacttaccgctcgttgccaatggtgatgacctgaccgtcgggaagctcataagacttctcaagggcagaggaggaggcagcagtctgcatctcctgctcaaagtcaagagcaacatagcagagcttctccttgatgtcacgaacgatttcacgctcggccgaggtggagaaggagtaaccacgctccatgaggatcttcatgaggtagtcggtcaagtcacgaccagcaagatcgagacggaggatggcgtggggaagagcgtaaccctcgtagatggggacggtgtgtgtgacaccatcgccagaatcgagaacgataccggtggtacgacccgaggcatacagggaaaggacagcctggatggagacgtagaaggcgggggcgttgaaggtctcgaacatgatctgggtcatcttctcgcggttggacttggggttaaggggagcctcagtcaagaggacggggtgctcctcgggagcgacacgcagctcgttgtagaaggtgtgatgccagatcttctccatgtcgtcccagttcgtgacgataccgtgctcaatggggtacttcaaagtgagaataccacgcttggactgggcctcgtctccaacatacgagtccttctgacccataccgaccatcacaccctggtggcgaggacgaccgacgatctattaacgtgagaagtgggaagggtaaaaagctttagtcaaccacacacacacacgtcaccaaaattccaagaggaaagacaggtatttgactcgtcgactgacatgcagtatgaggacttacactggggaagacagcgcgaggagcatcatctccagcgaaaccggccttgcacataccctaaacgcgattgcacaagccaagtgatgaagagactgttaactcagatacaggacgtagtttgcatagatcgaaggcgccgatataaagctggcgattatgccggcgacacttaccgaaccgttatcaacgaccaatgctgcgacttcttcttccatactattgagtaagattacacagtgagtttgattaatatgatgagatacatgtacatggctcaacaattccatggtcaagcaggccatgaataaggtgaagatagaacgcgcaaagctgcaaggagggagaaaaaaggctcgaggcctcgagacggcgacgcgataaagtatctctactatcacgatttgctgcccacgacactttcaccacatagaatcgcgatggggaagctcgaaagcagcagagtggacgtgtggccgaagcgtgtacttggctcagagaagagggtgtgcgagtgtgatagagtgcgcaaaatgggggtgaggtcggtagagaatgtcgaacgaagagcacagcaacgacacgggcatgtgttcgatgctggatgaaccaggtgatcacacgattggaatgtggccttggacgctaacacacgcacgcacacgcacacacacgcacacacacacacgtatccacacgcagacactgggtgtggcccgatacgacgcagacttactttgctgtttgggttgtgtgagaaaagggagagttaggtagtagagcggaggtcctttgagagaggatgaaaggaagatgatgagggagagagagatgaagactgagggcagaagaagattagaaaaaaaggcagaaattggcggagttgcacatcacaatttatacacctcaggcagacaccacagcgacacactcgattgtgtgcgtgtatgtgggaggggcgagacagagaaaaagggagagtgcgacaaacaaaacgatctcctcaagcgacacaactcgcatctacgctagaggcggcggatcgcgcgtctctgataggcacgcgcccacccgtgcacgcagcaagcgacatgccaacacgcacgttgaccttgttcgcatgaattcgccagcagaagaaggggttgcgctgggggttggttgtttggaacaagagggtggccaagaggaccaccctgcgatctgttatagattccttcctccttcccgcaacacccttgcctgctgtcccccttctccctccccttctcccccggcatgaaggaactttcctagtgctttttacgctgcgcttttcataattcccagagcattctgctagactacatgtagtgtcaagtccttatgtgatagcaggcaaaaggagttgctatgcaactcatggaggggacgcacaggaccaagcaaggatatcgaaccatcccagcatctctatttctccctttccccgtcaatttcataccgacttgggacaatagttgctctgagctagagccgacttccgttgactatactgtctagacacgcgatgcgtcgctcgttgcgcccccgagtgctccaacagcaatcaaacgctggcctatcgtttgatccatcgacccttgacttgccgccgcaacaaaaagcgacactacagcagtgcgaggtatttaaagtgtcgatggcccatatgcaatacgttgtacgtagtttggttttattaggtcacgtccttcagcagctgcatccagaagcctctgcggagctctcggcattgggttggagtcgaacattggcaggggcttgcttttgccagagactgggcgtgtcaatgatttgctgcaccagctcgtcaaacgcctgctgaacgccgagttttgtctttgcactgcactctacaaacaatgtctgcaactttcgtgcaaactcctggccttcctgcttgctgacttctctgcttgactcctaaggtgacaaggcagcacagaatgcggtcagatcgatgcgacagcagggtaaaacggaagcgagccatcgtagggaaagaggacagcgagaaacaaaacagtgccaagattttcttactttgtcgaccttgttgcctacaatcatgcgcacaacctccttgctcgaacagtatgtgtcgagttcattgaaccacgtctgcaggtcgttgaacgagtcgcgactgctgacatcgtacactatacaggtttgcgaaaagacatcctattgccttagttttgagtgacttcatgagatcatcatggctgcatgtcaactgagaaatcctacctaggatgacgccttgtgcccctcggtagtaggaggatgtcaaagtccggaagcgttcttgaccagcggtatcctatgtgaacgaagcaagtagggagcttgttagagccccagctggctcagttgtgccatcgctgatatggacacacgcacagcgtgacaagtggagtatgacgctgaagcaccgaggcattgttgaagcaccccgtcacccgacttgagctggtgcaacttacccaaatagtcagcttgtactttttgccctcgacatctatgactttgactttgaagtcgacgccgatggtggccgagatctcgtctggggctaggaagacaccgtcgacaaagcgcatgagcagactgctctttcctgtgccgctgcttccgatgagcaacagcttgagcgttgcgactgtttctgaggaggacgagtgattcgattcggccatgctggttgtgaagtgtggattaaggatggcaggagcaggacaaggacaagggtcaagatgagaaggggattagcaagcacagagaagggttgaagtcggtttgaggaaaaggacaggaggaatgagcaaaaggaccaagcgatgggggcagagtgagtatgggtgaaaagagaaatgagcgagatggatgacacgcgccaaacattagtagcgaaccacgttgctagcagggtgactgctcatcctctatccatgcgcttgaagccacggaaacgcgtcgccctttttttgttgcatcactccctcggttcctcattgaatccgctctttctttgctttcctttacgcgcgcccgtggccacacctacacacacacctacacacacacatacacacatacacacgcacaccttcaacacccttcccctttcactccgcctcatcccgtagcagccctccacatggcacccaacgagccaacgctagacgagatcatcgcaaagatccagtcttgctcagacaccgccaccatcacaaagaccctgttgcccttcctcaacaacctccacgagagcttcttttcggccagaccgcacggccaaaccgaccccatcgacgtcctctcacctgctgcccactcctttgcctacctgtacttcctgtaagaccgcactcgtttagacttttttcagatgtgcattctggcccttgaagccgtggctcacagaagactacttgctccccgcagggtttatcgatgcaaggcgtcgcacggattccaccccgcactactggagaaggtgtgggcattcgtcacaacctgcaacggcgaccagattcgcgccgcgtctgataaaggtttgtttgactccctgagcataaaaatcaaagctgctcctgcgcaagcttcgactgccgcagctgcattctaaccctcttaagctcgcttttcccccacgctccgcgtaatgttgagttagctttgagctttgcagaagctttggtcaagatggctatggaatcccaccaggtatgtagatgaagaaggaatgcgcgccgcttaggaagggtgtggactgacgctctccgtcgtacttcgcgcaactcaacacacttagcccatcatcgctatcagaccgctggccgtcttcatccagagaattcaactgtctccagggcagctcacaatgatccatccgcttctggctaaggtaaatttttttttgaccagttccaccgtgggtgtcaatgtacacctcgttcagcagtcaacttacacttcgtcctccgcactcgtagacatgcttgctagcacagtcgttcaaggatattgttcctattctggactgcgacatctcggacgtgaatcctacggtacgcgcttttgcagcaagcaagcaagagacgcttgtttgaaagctaaattctgatgaagtttactttgccatatttactggtatacagagcacccacatcgattacagagactttctgctctatcactactatggcggcatgatctatgcatatctcaagcactttgaacgtgcagtcgaattcttcaaactggttagtgacagaccttctgatggggctcaaactggttgtcaagatcactcgatccttagtgcgataactaatcctttcgatcctcgattaggccgtatcggcccctgcagacgtcgccagtgcgattcagatcgagtcgtacaaaaagtacgttctcacgagcctcctccactatggcaaagtaagcttcccccagcagtatgcatttcgttctcgtcgttttaaagaggagtacagtgactaatactgaccgtgttaataggtgccgaacttgcccaaatacacagcgacggctgtcaatagatgcttaaagttgcattgcgtgccctactcagagtttgcggtggcatacgagaaaaagtcaaacagcgccatcaggacagaactggaaaagcacaagcaggccctggtgcgggaccggaattatggactagctaagcaatgcatggaggcgctgcatcgccggaacattcaagacttgacgcgcacctacctcacactttcgattgaggatattacttcgattattggccttggctcggatcaggatggcacaagacgcgtcgaaggaatcatcgtccgtatgatcgaatcgggcgacatctttgctacaatcagccatgaacacgcaggaggaatggtctcgttcctagacgatcctaaccagcacaacaacacagctaccatggacaagatcaatgctcagatgcaaaaggcgacagctatcacgtcgagtctcatcgccatggaccaagccatctccagtatgccagcctatttcaacaaggtacatattctgtggagaccgccgtctcttatgctcaacggctttatcatggctaaagaaatggatgctcgacgaagaccgctcgtttgcctactctgacaccccgtatgcatacgtatagggatctcatacgatcgaccacccagcctatccaatggacgagtcggactatgggatgcagttgggctacgaagcctatgccgatgaaggttcgatcctgtccagtcccttatgccgattgattcagttctaaatatatgccggcaatggttgacgtgtgttgtgctttactacgttccaaatagaaagcctcctctagcgatccgaagaagcgtcgtttgtcacggggcggaaaaagaagaaagcagaaagcaagagctggactaggggctggtggagcggccattcagctggacatggaccaggaagaagtaacgggccctcttgagacggcgaacgagtccgaaaatccagatgcttaactggatggcacggcatcgacacggcgcttctacattccggaagaactcttcctgccaagtcgaaaagactgagccgactactgcgctattaaaaccgcgagagtttcttgctcaatcgtgtcaagtggacacgcgagtgacatatttgcagcgatggaaccattcacgtgtacctgctgcctagaccaaacgacttaacactagtccttgtcgacaggacgcgcagtttggctgttggaaggttctgacaatagggagcagcatcagggcaggactctcctttccggcccccatgtgcagtgcacccatgaatccatgttcgcgccttgagggtttcgatatcactccttttctaacatacagaagaggaagaagggctggcgctcatcatcgcattcttttttcagcactttcgtccccctttgcaacgactcctgcaatttgatgccagcgtgcccttgaaccgtctgtcccttactctgcaaaggttttttcagttatttctcagacaacaacaggtctccaggaggaagggggttctcggtccctttttgcatccccgttatgcctcctggtgaatgaatcgctggtgtagcctggtagtgaaagaaaagaagccaagatgggaggggtacggggagtgtggggagggggctttgctttgcctcgtccttttttgaagtttgaaagaagctatatctattgctttttatgcctttgtctttctttttttctacatccatcctctgcttgtcagcacacagcccttcaaatcttctcagaacagctacagcttggagatatgctcgccatcttcacatcatgcgtctttggaatgctggcattctcagcaatgcttgccagtgtatctgccctggatggtaggcaatatgatttgagccattgggccgacacttgcgtgggtctctgagcgttcactgtgtgcgagaaaatcattctgaccggtcattgccttttgtagtgatgaagatcgacaacagcacaaagttgacgtggtgccaaaaccaagtcggattctggtaggtggctctctcgcacccggatgaaagcatcggacgacaaccacttcagttggcttcagcatgtagacttttcaacagcactcttcgtattctgatcataccctactcatcctgtcttgtatctcttagtaccaatgtctgtcaggaactgaccaatggcgccgagacccacagcaaccaatgtgacatccagacccttgacttcatctgcgaatgcagtgatggtgctgccccaaatatcactggtaggaactgtcgctctctccctctctttctttctgtgttctctttcgttttacggaaaccaaaggcgtgtcaaacttgccactcacgatgcgtacgcaaacctcgttttttcttcagaatacacctacacgataccatactttttgtgcacggccgaaaatcaagaatgcattcaaaactgcaaactgtcagacaacaactgttatacaggatgcacccagaagcgcaactgtaccgcagagtttccaaagaattacaaccagtccattcccacgtctctgccccagcccacagcgccagctggtactcaagcgactggcattcctccaggtatctttgataatgcagcgaacagtgtccattcctggacatctgtgggcggctcgagcctgttggggttggtggtctttctgacggttggagtactgtttggtgatcagcgcatggactaagagccgtgtaggtgttgagagagtagtcctggtcggtcgtatacacacaataaacttaatacgcgttgtcgccctttgaaagttatgatgagcggcagactgagcagtgaatggttcgcgctatggtactcgcgattcacgttccgcgagacgacgattttgttcttggaccagctctgtttgtcactttaactttcgagcagacactttatgaatggcgtgtcctcctctccccgtgtccaaagtgcagaagagcaaatcatctgagcagcccaacacacaagcacccactttttgtgcaaccgatcagctttcactcaatgaaaccgctttttttctctcttgttgctgttttcttcttcatcttctctcctcccacaccagagaaccaaaagtcaccacctctgcaccatatatcgccctctttgccgtgagcgcggtcatacctcacccagaaagccattcctcatgaccgtctacacgtctcacgtccccgacagggtgatcccccacatgaacgcgtatgagttcatggtctccaaccccaaccacactccggactcgcatcctgtgctagtggactctttgaccaaacgggtggtccactatggcgaatggaagcgcgacacgcgtcggtgggcgacaggacttcagtccattggcttcaagcaaggcgatgtcttgggactgttttcgttcaaccaggtggattactcgatcgccatgtttggaccgattctcatgggggccatcacgaccacggtgaatgcttcctatacggtggatgagctcgcttatcagctgttggattcaggtgcctcggtcttggtcacccatccagaactgctgccagtcgcgagagcgggggcccaacgagcggggcttcccgaagacaggattttcgtttttggtgagcaggtggtggatgggttccgaccgtacagcgcactgatgcctcctatgtcgttgtctgcacctgtaccggaagatcagctggcagaggtgatgccgttggaaggcccgctggcgaaggagaccacggctttgatctgttactcgagtgggacgacggggaggagtaaaggtgtggaactgtcgcatttgaatatcgttgcgaatgcgctgcaggtttcggcgttggatggaccgctcttgccgcatgagaatgtttccttgagcgtgctgcccatgtatcacatgtaagggttcctcgttcctccagcttgtcctcatgcaactcggctgtgcgggatcatggtgggctcatcgtagtacgtggtttttttatgcctctctttctccaggtacagcatcatgatccatctggtctgcggcctgtacaatgtaagcactgtcgagtggatgtgagacaggaggtttccacgctcggagattacaggctgtgattgagtgttcacccaccaccgattcttctcgctgctgcatccccagggcattccgaatgtcgtcctccaaaaattcaatcccgaggactttctccgtgcgatccaggactacaaaagtaagagagtgtgtacctgcgaatagttcttgacatctcttttgagatgaacaaagacactaaactctccccgttttgcgttctgtgttgtagtcaagactctcaatctcgttccaccacaggtgctgctgctggtcaagtctcctctggtgcaaaagtacaatctctcatcggtccagaatgtcatggcaggagcagcgccttgctccaaggagctcatcgaagccttgatgagtcgattcccgcagatagcgttccgacaggcatacggcatgtctgagctctctcccgcctcgcacatcggtctctatgagcccatggtccatggatctgcaggtcgtgttttacctaatcaggaggtgcgtgttgtcgatccccagactggcaaggatgcagtccagggcgaacgtggcgagatttgggtccgaggtccaaatgtgatgaagggctaccgcaacaatgcagcggctacaagggaaaccattgacgccgagggatggttgcatacgggggatatagcggtggtggatgcgagcggaaatttttttgtggtggatcgactcaaggagctgatcaagtacaagggctttcaggtggcccccgcagaactagaggcgatcttgctgacccatcctcagatcttggactcggccgtgattggggtggaagatcccgagcaggcgaccgaggtgcccatggcgtttgtggtcaggaacgaggcgactgcggtggggagggcgttgaccgagcgggaggtggttgagtttgtgagtgagaaggtggcggcgcacaagcggctccggggtggggtgcggttcatcgatgtgatcccaaagtcggcagcaggcaagatcttgcgcaaggatctgcgggtgcttgtgcagcccaagacgttggctaggctatagagagataagtatttcttttaaattaaagtgctcggtcaagctgctgcaggagcgcgaggccagggcgctgcatgcatttaggccgccaacggcagatatgcagccagagactgtaagtcatggctcgtcctttagcagcccccaagggtagtcgcgctccttcgtttgttctgcctctcgttcccttctttcacctctgccacctgtgatccttctgcctgtggatcccttttgctactgctttgcctctgccttgtgtgccgctctgtctcgaccacgcgtgcgcgagtgttgaggaagcccctcaattaccgtgcgaccatgtccatgcgccttgtgcgataaagtctggcctgcataaggacaccctcgccccacaagcacaagtcgactcgcccatctcgctttgcccttcgactcattcttctctctcttcacccccgatcccacacacacaccagacacaccaccaccaccaccatcactaccactaccaccaccgtaacctcattgttctccagtcctcgtcctgcagcctcatccctcaaactgtgtgcacactgcagattacgcccacaaaaaatagacgctgtcgctgctcaaagaacgctgtcgtgggtctccaactccacgaggtacattgtctgtccagtcaatcggcagccttgcacacccatccctcgccttgcagcagcagtgagaaggactcgaggacactgtcggcgtacgcgtgctcactttgcgcatactcagtgttgtggcattccttgctaaaatcgcattcctacttgtttagcccgccacacctgcatttcacatcctacgctctcagaatggccacgccgctatcgccagtcctggactgtaccgagttcgtggccgcagagggacgctacgagctcttgcaggacatttctctggaccaagtcctgccccatcccgtcatcccgactcacgtctcgtccgtgtccgtaaagtacaaggactacttcaactccagcaatgggtcgcgcgcccacggcaagcagacgagcgccgatagtaccctctcggtcacaaacctcgatcgtctggaggagcggcttcgagacttcaagctcagggacgaaaagggcgcctttgagaatgacgaggacgacacaccgacagagagcgcaggaaaccgaccacgcagcagcagccacggaggaacgctgtcccgaaattttcatggtaaccttgtcgacctgccactctatcacgacgacagcagtgctggaggcgggtacaagagcccacgaagtggcatgatgtcgccggggcttcccttggctgccctgacgcctggcccgcctcccttgaaggactcgacagcctcaagtcgcatcacagatccattctctcaattcggagcaccgccgcctgtgcctctgcatcatccgcctccgccccatagtttcaagagccttagcagagcgagcagtcattactcgcaggctccagacgacagcagcaacaatagcggctctggcagccagtcgtcatttgcaacgggcagctcttctgcaggattttcgtccttcttcagcagcaagaggaaaaaacccaaaaacaacatcacaaagacaaactccacctttgtggcaaagatctcgacgcacgacaacctggcaaagatcctggcgaaccgtgtgggcgaggatgtctacttgttctggaacacgggtagaacgttcgcatggagtgacctgggacaaaagccgaacgtaagatcatgtgtgatttgctgcatagagccatcgaacgaaggctgcgcctctgcaaaacttttgctcaccttcagacacaaaacacgacccgcccgtcatctttttgcaccgccaatctgcatacaaacgcacataggaacccttgtcccagatctccttctcgaaagcgtttcccacgtcgcacgacgtgaacgtcctcacgaggagttgcgatcatctggatgttatcattggattctcaaccggcgacattatctggttcgacccattgtgcaacaaatactatcgactcaacaagcaggtacatagtgactttcaggacttgatgcggcgtctgaagcatagcggcatttcaagtcgatggcatgctgaccttcccttgtgtgaactgctggacattataggcgattatcaaggacagcgcggtgacaatgataaagtggctgcctggatctgagaaccagttcatggcagcattccatgatggcagcgttttgatcatggacaaggaaagggacgacaacgctttcagtgcgcccattccaaccagtgatagcacgtaagtcacattgttccttgctgtctttaccgcaataagtagtggagagtatttggacaaggaaactggaaccccttccacacatgaaaaggccaagtttttcagctcgcgactgcgctctgcgttatggctgttcggccatgaacttggcgaaggtgtccgccaccgaaagagaaagcattatgggggcagtcaaagttgctgtttgttgacatgcttgtcaatgaggtgtattctctcggcagggcacgttgagatcaaaagctgcaatttgggctgccctgtctatctttcgtatttccacataaggtggcggacatagctgtgatgccaagcgaaggcgcgagcacaaaaacttggtcgctccatgtataggaaggggttcaaattgtgtttttgtcgaaacacttttgttgaccacactgcaccatgaacgtcgatggggactgggcgactgctaatacctctacacccatattttctgtctgtttgtatcagctttcatgtaacaaggccaaagcacagcaagcacaatcccatcgcacattggcaagtgtgcaaaaagccgattacaggtacgaaaaaagaaaatcttgtcactgagactagtccgaaatagtggatgcatctaatgtccgtctccttcgccctatagcatttgcattctcgcctgatctgcagcatgtggctgtggtggccatggatggtggcctcaggataattgactttcagcagggacggctgctggacacgttctctgcctactttggggcactgaactgcgtctgctggagccccgatggcaaatacatcttgactggtggacaggatgacctggtgacgatctggtcattcaaagaccagagaatcgttgcccgttgtcaagggcatcagtcgtatgtcaccggtgtcgcattcgatccttggagatgcgacgagcgtaactatcgcttcggaagcgtgggcgaggacgccaaacttttattatgggatttcagtgttggcgcccttcataaaccaaaggctgtaagtcagatcgctccacggactttttgatgtacttcaggtattctatcagcttctcacactggatcaaaaacaaaaatgatgtaggcggcgatgcagaggcgtggaagcaacaccacggtgtcgggaacgggcgctacaggaagcaacagctataaaccaggacatggaagcaagggcagcatcagcagtcttcgtggaatcggtggccacagtcttttctctggccatccacatagcaacacgtcctcaatcacccaatccccacaatcctcgctctctgcgactcatcatcacccaccccatcaccatgctgcgcatgcgacgcagcccatcatcgctgaggagtcctcgcaggaactgacggccggaggagaggccccctccgtgggatcctcgacccgcaacggcagtgttcacaatgacagcaaccaccaccaccaccaccctcaacagcagcaccagcagcaacagtctgcaaacacgttttcttcaaagtcaggggagaacgcttcattaggagatggatcctcgaccacttcgtcggtgcactctgcaacgcctgcctcagaacatgagggcgttcaggaggcagccgatatgtgctcatccaatggcgtctacaagaagcccgcccacgcccgcaccctgcctcatctacacttgcacaagtcgcttggtgcacatcaacaggaggatcatagccatcacaataataacaacgggcatccacatgcacacgatcatggacatggacatggacatggactatcagcgtttttccgatcagtaacgcattccttgaacccacacgaaggggtgcagatcgtgcgaccgcccgagcctcgatcgcacgtggcgatgctgcagccattgatggcgaaagggatccatctggagccgttggcgagcatcaccttccgtgaggatgcgctcatgaccagcgaccggagaggtcatatcaaagtgtggaagcggccgccacccctgccgcatcacccatagagtccaaaccgcccccctcccctactcgattgtagtttctttttctcatctatttaacgctcatatttctctgtgagataaatgtttgaagatggagcatccaagatatataccctccttccctccttacacagacaggtcatagaaaaagtaaaattgttattgccatgtgtcttctagtctaagggggaagaagggatgtctatgttgggtaaagcaatcgtttgactgttatacaaaaaagtgggtatgggtgcgactctcctgatgaacgttcatctcctggctcttgaactggttcagctcgagctttatcttctgcgcaatggccggggtcagacgatgggcagtgatattggggtcgctcgtgcgatcatactggtctgaggtccaggtggtgtggatggtgggttgagcggtcgagaactggagctggcgcgtggggcgggcgaggtggatggttttgttggagggcgaagagggcgaggatcggaaaatagtgttggtatgggtattcggataggggttgccgccgagatggctgctgctgctggtcatggacatgtggccggggttgaaggcctgagagtgtgcgtgtgggtggtatggagtcgcgtgttgcggggaggaagggtagtggaggtgggaggacatagactgctgctgttgctgctgctgctgctgttgaacattgtactggtactggtaaggggagtaaggatgagggtggtagggttgttcctggagaggaatgtgtgaggcatggggaggggagtgaggcaaggagcaattcataaactgctgctgttgctgctgttgctgctgtgcctgctgtgcctgctgctgctggtgctggtctgacagatagtggtgttggaactgctgctggtttcgctggaattgttgctgctggacatgcagctgctgttgaatctggatctgctgttgatgctggaggtactggtgatggctgttcacactcttcacgaacccctggtggggctccatcatgagcgagtggtcgaccgagagacgcgacacgggcgcgacaatgagcgaattgcgtttgctgctgtaattgctggcagtgacgggactctcgccttgctgatacgagctgcggcgatgttgatggttcatgacattggcaagggccggattacgggggacgatcttcactgctgggctgacgccattgagattgctggaggatgcggccaactcgggcgaggtctccttggaggtgggtccagaggtcaaaggcgactgcacttcattggcacctgtgcctacgccggatccagggatcgcttgttgcgactgtgcctccgccccagaggcagacgagaaggagcctcttgaagggacgaacgacatgggcgagagcatgcttccgttgaacgacgctgcgtcctctccctgatgaacggggaacatcctcggtgctgatgaggtcgagcccgttaacgcgaacgcgtcgaaatcatgcgatggctggccactgagatagccgccttggtaatgatacggctgagcttgaagctgttggaactgctgcggttgctgatagtgagggtgctgtcggacaggagcgaacgcatcagcatactgaaagatgtcaaactcttcagaggtcgagtaacgcatcgagagacggtgcggcttcctctcgatggctgggtagttaccctgttgactcgcatgacggcttgcaatactactctgacggcgatgacgggtaggcccaacaatcctctccatagattgacggatttgctgctgctgctgctgctgctgctgctgctggtcttcagccgatgtacggcgactgacggtgggaccggcatctggagacaggtccaccaagggctcgcacaggctgtggcgtctgctggacggagcagtcgctccctgcgagtggtggtcgaactgaattggtgattgtccatagatgctcgtccggttcatctgggcggtcctcttgaacgagagctggcgttggtggcgattgaccaatgcagatcgcaagggcctcgcaggcaatgcagtcgccgtactattagcggcatctggagccgcctcaaccgcgatggcgttctgcgcgggaccgctcttgctttttcttcgactctgtttggcgaacacgctgtgaatccttgactttttgcgggtcaactcggatgcgtcttcggaggaagcaatgtttgattccgctgagttgctcttgcttttagaactagaagacgcgaggagctcagccgcggcggcagcagcctgtgcagaggcaccatctttatcccacggtgggtttacgaacttgtagagtggaatctgctcctgcttttggtggaatcggccgccgacttgcatatcgttgagcgaatgccgtctggggaatccagcaatctgacgtcctacaatgaccaaaggatgctcgacatttgggactgatgacgctcgctgatcacgcttttgagtggccttggccaacagctcgtctgagcgcgggttaaagaacgatgtgatagaggcgaatgacagtctctttttcacggtcctcgtctggataggttcgagattctgtcgtttgccggctttgtgaatgccctcggacttgggctcgaaggtggcatcctcgacaatagggaccaaattgagtggcaccgtgatatcctgttctcctgaaatagacgcgagtctcgtgggtggcaactgcaatgagagactcctaaccttgggcgatcctgcaggcgacatttctggcgaggtggacggcgtaataaccgcaaactccccaggagctgccgacatggtcgtgtcagcagaactggtcgatgagactgagccgcgctgatttttcaaaagcgagcttggcacgtagtcctggccgaacatcgatgaggacgcgccgtcgtcgcgtggtgacatggatatgatgtcctcgagcgcttgaggttgttgcagcatatctgaatcggccagctcgagattttgtccagatgcactgacgatgggtttgttgaaaaccttgcgaattttggaggcgagggtcgatttctttcgcagtttttgagcagaagcctgctggaaagaagtgttcacaaagggcaactgctgcgtatgagtgggagaccccagtggcgagaccagatgccagcggtcgatcgatgcagtaggactcgtgggtggatgggctattacgttggacaatgaggtattgatttgcaagagaggactggaggcaaaagtcaaccgaggctcaggattgagctgaagggggtggatcgactgttggtcgttggagacggctgtagcattgctgatgccaacttgatcgatcactgctggagtaggcgctactgccagctgcacctgaccttcatcgaatagagcgcgtcgactggtggcaacggtgtccgttgtggacacagtagtagtagtcgacccctctgtgatatatataaaaaaagggagaggcagggcgagaaagaaagaggaggcgagatccattataaagcaaaagggagacgcaagtcagtatggtgttttttttctgcaagggagccatcttgcgtaatgtggtgcatctcgaagtggcgtcggggtagatacacaacgctcctaggttcccaactcccatggctatagacgtggcagttgcttaccctctgcatcctccatcgatgataaaggcctggcatcttcggccgagactgacttcagcgctccttggtcctctagcgctgcggcatccagactaccgtaccgccgcttgtcgcgcaccaccagtggaaggggtccgacgggaggaaagaccaaatgtgaaggactggacgagagcgcgtccttcacacgctcgtctatgggactgttgcttaacattgtgggtacctcagcagctgcaccctgcaaaattgttgatggagagagggggcgagttggtggaaaagcagatagactggatgggtccaaggaaatagcagcagctgtgctggctacggtgctagtcgattgcgtcgcggagccgtttggtgaggagagtgagctgtagttcgactgactgcccataagcgttgagaaggtgtccagcgtatcttgtgcaaacccttgcgcggtcggttgatcctcaaggttatcaggggtgggtatgtgcaacaactgcaactgaagtggctggtccgaggacgtggcagtgttggttgggcatttgcgggaaacagtcgcaggtgggttggatgcagaggatgacgatgaagagctgaaaggttgcgaaaggtggagctttaaggaagaggaagcgcgcgccaacagcggcttggtgaacgctatgggtgtttggatctttgttccaccactatgtctgcgagctaaaagctgctgttgatggtttcgcagaggggattccatggttctggaggaaaggatgttggtcattatacagagcaagagcggttctgggatgaagcaagaggcaccaagcgtgttcaaaggaaggtgagaggactttatgcgaggtggaggcaaagatcgaacgggttgcagaggcagccagaaaactgcggatggtgacaaaacaaagaccttgcgcttctctctttttttttttttttttttttttttttttcaaggagagtgggtgctggaaaacgtggccgatgtgctggggtgaggcggatgacctaaagacgctacaacggagggtcagaaagcctctgatgatgaagacaggccaggtcgaagtgggctgggaggttaaagagtgaaggcaaagcagaacaaagtgaaaaggaagtaaaaagggtaaaagtaggattttgtttcatagacagaggaacacactgacacgaacggacggaagcgctcatcccctcactcgcttcgggtagcccgacagaaatcaaaacagacgggggcctactcttccatggcgttcaaggagagccagcgcttggcccgaaagttcaacgatatgaagggggaggatcaccattgatttattatcgctccgttccgtcctctcatcttcgctcaatttctctgtcaacgttgcgagctcatctttgtccataagctacagttgttgcgcagatagacattttttttttcttttttggagaagcaaggatagcatctgcttttcttcacaaagcgcggaaataatgggcatgatacaaagatgcttttcagtattgctcagggggtatgtaaaagcgccaggtttggtgagctgaagcaactggcgatgaaccaagaggcacatgcaatgcgccctccgaatataaagtcttttggactccaaaaagccgagtcgttcaacgagatttcaatgcgaacgcaggaaaaaagggagggagctggggaaagaaggggaaagacacaggaaaccaggaaaaaacgatagagtgaatagaaagagctgggagtttgagaggacgggaaaaaagggtgaaggcaagcatgggagtgaaaaggagaaagaggcaaggttgttacagcgacatcgacatatgaaccttgaatcatacatcgcattacaatagtcgtgctaaggcagccagtgcgcctggacctggttttgagctggatgctgctccccttttcggcagattacacaacgaataagctgggacatggcctcaatcgcacatcggatctggatctggagcagtcatatctccgcgagcgaggctcagcatgtccgtatcgtcattggatctgaaggggagtgaagaggttccgttgaggacaagagggaggcttttgagggcatatcatcaggaacccgatgcctatacctctccattgcagatatcaggcaaattgttgtctttaataaacgcgcgatgtggcgacgtgatcgggtaccgaagacgtggacgggtcgcgtgctgaagtagacggtataggatcagtctataatcgaggagcttgttgtggtcacgtcgctagttccggggccaatatcagcggaacacaacaggaaagagagcaagactaacaaccgatcgcgttcctgcgcatgacaaaccacgcaggtgtggttgcttccatggtagcaagacaaaaaaaaaagcgagcaagatgtgggggcaccagagcatcgccttcttctcctgttgttttcagccccttacctatcctgtaaaccctcgattctgacgctaatctgttcagccgtgtcctgcgtgcaaggatgcccccttcttttgcttcctttttctcgcttttgcttccattatgcaaacttctaatgtgtgcgacaacggcggagaacacaaaggggcagaggtactcaagacgagagctgggaatggagcgaggcggagaggcatgcgccgcaaatcagccggaaactcatgtcagtgattggcactgtgcagacagagagtacaactgtgtccggccaaggttgttgtccgagaattccagcgttcttgctgtagagcgacgtacgtgcagaggagtaccatttcctttcattttgagaacaacgcgcatgggagagaatgtgggtcgcttgtgctctgtgtataccgcataaaaaaagagcgctctgatgaaccaccatgcccctgtgtcccatcacgcacacacgcctttccctgtctgtgttcttttcatttctatttccttcgttccttcctccttcctccttcacgctccaccctccctctttgcgttggaagtgcacctctgcagtttctttcgactctcctccaccccagctcaaccacctgcccaccgccgattccctctgctacgaccgaagcggacggcacaggaaaaacgaaaagccagcttccaatctcacaccactttttgctgcatccagccatgatcacgacgtccgcagcagcaggcccaagcagcccgacagccagccctcatatacagcaactgaccgaggacatgctgcagttggcggaggtatgtgatccttgccatctgaacggatagagaaccttatccatgcccagaccaacctgacgaaaaagcaccgccgacactgtgcagacaatagccatatccgaggagggaaaacagcttcgggagaacttgctgacacgagtccaaggaatcttgaacacggaatggcccaaggaggccaagattgagtcctttgggtgagcattcagaaagcattgacagcgtcgaccgtgggcaacgagaaagtgttttttttactgcgtgagagcagcgggcgttgcgacttgagaggactgactatctgatttttttattgctcccgcttcaaactgattctttgacattcgcgattgaatgacacgcgatgggtacgattgatctttcagttcattcgcctcaggactcgggacagattcgagcgacctggatcttgtggttttgccagcacttccggaacagagccatgaactaccaccaggaagataccaggacctctatgtgcttaagactctgtttctacgctgtacgtgtgttacattctttttcttctttttcctttggcgactctgtcgggtctgtgatgcatgcgcacggctggcggagaatgagagtcgacagtcgagtacccctggagtcaagacagcttacttaccttctttgtcacttctatctatgtttccatccctgctgccgcctctgattgaactctttcgtccgctcattccgcgactcatcgttgccttttgcctgtctgtttgaatggcgcggggaactgataataatcaaatgacttggacgtgtcgtctgtaccttgtaatgcatggatatctccctcgactaccgtgaaatcacgcttccactggtacagacagcatgaaggacgttgaggtaattcctgctgcaagggtgcccatcctcaagttcacggaccataagacgggcatcaaggtcgatctcaactgcggccactacagtggactttataacacgcgcctaatagaggcttatgttcgcattgatgaccgtgttcgcacgttcatctacgtcctcaaggcctttgtcaaagcgcgcggaatcaactcacctccattgggatctctcagcagctactgctacaccctgatggccatttcgtattttcagacgctgttgcttcctgtgcttccttgtctgcaggatcctcacctcatcccgcacaccgtgcccaaccctggtcccttcggatcgacgcaccatatcaacgttgcattcaccgatccctcgaggatcaggccctgcatcccgaggaacagcatgtctctgggggagctcttcataggatttttggagtactatggaagcaagtttgactacaggaaatcatgtgtgagcattcgatgcggcggtgtcgtaccacgggagcggcacggaccttccagctggatgaagcatgagtttgttgtggaggatcctttcatcttggacttaaatgctgctggagcgcggcataacatgatgaacatcattaggcacgagttccaggccgctgtacaggctctgagggacgggcgaggtctgagtgccattctcactacgaaagctccatatcaagttctgtcatagccaagtatgcttttttttttgaatttttaaggcgagatcacaagcatccagtagtctaggagcgcgttactgagcattccccttggccatatcatactcgaacagctttcacggtctgtaccccctttatgggcctggctttcttgtccagtctattcactcaacatcaaaagctccgaaaggctggtggtgcttcgcccctagactagaatgtttccacaagtgtttcgcagacccataccattcataaaatgaatacgtccctcataccgttgttagagcagcgattttttttcctcaggtatcactgaatgccgatttatgaatatgtgcgaggggggataatgacgatagtatgcagagagagagagagatagacaaggacgagagagaggcatggaccgggggagggtatcacatctaaaaggtaaccttgtttcccttgaactcgacaataccctgtggtgctctctgagcgttcgccaaggcaaggcctgggcgctgatgtccttgcagcttcttggccggggcatctccaggctgacgtctctggcgcttggccttttgctcggcattgaattttctcctctcgtcctctgctgcttctgctgcctctgctgctgccacttcctccttctgcgatggtgggacctcgcctctagcaatggcagctgcatcctcctcctcacgcttacgtttcctgaactctcgagggttgcccttcaaggtcgcctcctccgatgcatattcgatattgagtttgcgcccatccaagaaatgcttggttgggttcgtcagtgcggccgtagcagactcggggctcatgtaatcaatgtatgcgaaactattcgtgcaagacaataagtgcgttaggcgcagagtagatgtgctttcctttgttggagatgcataatgaaatgaccgcgcaaacagtgatcacttaccctttacactttccagagtcctcgaatgtcgccaaacgaaccttgcggatctctccacaatcctcaaacagcttttgcaatccctcacgtgttgactggaacgacaggttgcccacgaacagtgttggtgaaaccgcgtgcttctgcttcatggacttttcctgaactgctgccttggaaatcgcaggacggccctcaaaggacttgctggacttgatcagtaccttgcgcccttccagttccttctctgacatcttgatcgcctctacctgtgcatcagaagaggcaaaatccacatacgcaaaccccttgttgcccttcttgttgtatcctgaccctgtgggcatgttgacacgcgtgatgtcggcaccgacgtccttgaagaaatgtctcaaggctttttcagtggtcaagaaggacaggttgccaatccaaatgccatactcgcccttccggccggccccttccttcttctctttcttttccttcttcttcttgtccttcttgccctctacttcatcgccatctacatccccatcctcgttctcgggtgcctcagcctcatcatagtccattgcgccggccttcttcttgttctttttctttttgggctttttcttcttcgactttggtggaggttgggtgtcgggatcatcctcttcgtctgatgatgaagacgagtcagaatctgaagctacaggggccttcttcttgctgagtttgctattcttctttgatggtgtctgctccttgtcgccttcgctgtcgctgtcgtcgctgctctcctttctcttgctcgccttcttggagaccttcttttccttggcggcagtctttgatgccttgtcttttgcctccttctcgagcttcttcatctttttctatttgtcgagggtgttgatgagcaatgagaatacattcagtctggactggaaaggcatggctctaaaagggagtcctaccttttccttcttttcatccttgaccacgggcgcattgctgtgccatgtcaggaagtcgtagggctcgtcggaagcgtccatgactaaggcgagtgtgtgttgtgtgtgaagggaaagtgctgattcaaggctcaacaaacaaaaaaagaaaaagaaaaaaaaacactgtgacggctgtatttacaccattgacttcaccactgcttagaaaaacacactcttggcttgattgaacgttgactctgcggggcagtacgggcacttgaacttgttgctatagcagaaaagtgcgcagaaacatgttagggactcgactgaaggacacagggccagagagtaatagccctcgagattgcatgaaaatagcctcaacaaaaagcagcaaagcagctagtaaatacttgtttgacccacgactgagcttctgaagactctccttgcaaataacatgtccacatgccatcatcatcggtggattgtcctcggatgcttgttctttcgatactgggcacacaaagatggagtggaatttcgtctcgtctgtcaagttgatttccacctggtcaaagtcgaacaaaaggaaggatggttaggaaagaacagcgggcgacaccatgaagccctcggatccaaattcacaaataaccgtttctaacataccggcagctcactctgctgactccattcggtctttttagctttcatgatgcttgccatcttgatcatggtcggcatggcctgcgtgcctacagtgacactgaaatcggccatttcacaaaagaaggcacgccggttaggactgagcaaacaagccccaaagatacgagcatcagcatcaataggccttacctcacgtagagtgggctgtcgcaagaaagtccaatcaaactacaaaagtcgcgcgtgaacatgtgttggatatcggaatttgtgttcgggtccatgagatctgcgtagcgcgaggtcttgatatgatccataaagataatgcagcacataagacgcttaatatctaattcgtcagtgacgggtcaagaaagtgagcgactgtcctttgaatgttacatagccatcatggtccgtacaaacaggtcagtgttaccttcgatatgacggcctccaaaatatccaaagttctttcttgcgtaggcaatcgcatcttgcacctgtccggcctccagtagctgcaggtatctctgacgatggagtttaaattcgagagtgcttgatctcttttccagcccgcttctgtgccgcgtcgcccatctaaaaaatactgagagtcaatcatacaacgtatacacaaaaacaaccgaatcgggaccggttctggaggcacttactgtagtgcgggctccaagttgttctctttcagtgctgccactatgtcaaacatctccacgaattggtgacgcattgagtctgggacctccagtcctgcctcctacattggatttacataatttcgttaatatagattttggcataggttccgtttatgatggctgctatcagcttcaacttgcctttgcaaatgcgtctccaatctcaaagttgccctgccgaatgaaatgtgttgctatcgtcttcctcatgattctatccttgttatcgaatgcatgagggttgatggccgccatcatatctccagtaaatctctaaggtatgcgccagaagtaaatatcatccgtaagtcttccagtgcaccatagaaaagggggagtagtgacgagcggaactgagatgaaaaatgcacagagggacggagggtaataccttgtcgatgcctttagagtattttgacagtgcactctgaagctctttatactcgtttgaaatacgctctgaagttgaggaggctgactttcccagcgctgccaatgaagctgtggcagaggacgggtctggtatatgtcagaggagcagaaggtaccgcagggttagcttggagacaccaaaaggaaaggcgcagcttcaacgaaggcaaacgcaagcttaccctcacggattttctctttggcttcgttaacgacagctatcaaacgatcgagaggatcgcttgtttctaggactcgttgccttttgagtattttgtcatagtccttgattaacgagtccatggcaatcgggcaaaatgagcgcgaaggtcaggtctataggctgggcgagcaggggaaaggcagaatgatggttgctgcagctgtgcagaatgctctcggaggtggacagcaggacgaagagtcaaggaaggacgaagattgcaatggctccctggcgacgtgatgaatgtactggctgaaggaaaaggttgtcatgatgctgggcacagcgcatggagtgcgtaatcatgtgatgtgactgcgagtacgggcggcgtgctcagggcatggcgaagcaggggagggtaagtgaaacggcagcaagttgaagtttacaaaggattttttatcctcatcaaaaactacccaaggctcacgatgatcggagaatatctgtcaagcacagcctctccaatatcggatggggcgcttggtccagaagaaaaaccttaaggtacagtcaaatcccgcgcgcctaccgtccatcaggatgtttttttttgatttcagacgctcgctttgaaatacagtcaaccttctggttttgcgtacatgtactcccaaaatgaataactccattctgcatacaaaagtgtagacacaggtctctctaaacccctgtgaggcctaaaattctctcatctgaatacaattggggtggaccagagagttgactgttgcatgttcaggtgtagcggggtattttcaacagagaaaggccgcacgagccaaaaaaaagtggcttcagaaggttccacaatgaatacgtttcacgcgtgaaggccactcccccttttttcttcatttcacgtcctcgtcgactcacattctgtgacaacaacgctctgcaccgacaactcggaacctagctaagcatcgctgacactctctaagccctgcgttgcgagagcgagcgtgatccatcaccgaggcttctgcgaatgtctaccttttcctgctcggccttgtaggacgtgaaccaggagctccaagaacgcgaaaacaaagttaggttgaaatgcataatcagcaacaaaggaatatttgaagcgtataacagcgattcaacaactacactacagacacttcaacacagcttccattcaccacaactctctatgcacttaactcttcagagcggcacatccttgagtccttacccataaaaaacccccgccaaaaaccgcatttaacgagcatccctcgccctcaaacgagcatcgaggctagacagaagagcctgatacctaggtatgacgatcctatacagtgcttctcttaactcactatcgaaaaccagctcaaggccgatagtttgcgtggtatcagtaaccgaataacttcctgagctcataaagcaagacctgatcactaaaacgccacataccgtttttcttctctcttcctttctcaaccctgcgctagacactcgagacaaaagagtaagtgaaatgagctttgcaatgcagcttctgaatgagaatggccctcatctcagcaccctgcacagcggactaacgaccgcgaggccgcctcttatgctctttttctatgctagcatgggctcgagccaacataaaaggtgcgttttgtcttgtggatcgtcgcctgcatgcctgtgttctcttcttcgcgcagctagccccagacagccgactaacaacctcgagatcgtctcttttgctctttttctatgctagcacgggctcgagccaacagaaaaggtacgcttgtgtcgcgttgtttctcgcgtggttgactttgccccataggcttgccttcaatatgccaaagtcgagactaactcgcctacacaccgcctttcttctctctttcactctcaaccctgcgctagacactcgagccaaaagagtaagtgaaatgagctttgcaatgcagcttctgaatgagaatggccctcatcccagcaccctgcacagcgactaacgaccacgaggccgtctcttttgtgctttttctctgtgctagcacgggctcgagccaacggaaaaggtacgcttgtatcgcgttgtttctcgcgtggttgatttgcacatatgcttctcgcccaaaaagccaaactgaaggctaactcgcctgcataccgtctttgttctctctttcactctcaaccctgcgctagacactcgagccaaaagagtaagtgcaatgagctttgcaatgcagcttctgaatgagaatggccctcatcccagcaccctgcacagcggattaacaaccttgagaccttcgctctgtctttttcatgtttctactgcatagtcctgagccaccaagaaaggtacgtcccatttcttgctgatcctcgcttggttatcaacctgctccgtcaattgtggtggaggttcaattcttctctttttgccggctaataccgggctttctctctgatccggtagcaggtctactgcggcgttgcctttcactgcataagttgaatgcgacgttgatcaagaggaatttaggcgtcaattcctaataaacaaatttctttgaagaggtgttgtattagccgttcagttgcattgcacattgctccgagctactggctcgtctagactgtacggctcaggatgacagagtgaacgtgctgctttagcattcgtaagctttagcgggaacttgtccggttcagttcgccttgcactgcagtttgcatgccctcatgcctagatgcctcgtcggggcgaacgtcgaggttacgaatttcactcagccagtttcctgacaaaaggtctcgattcgtgatttggctgtgccattggcggcgtgtgctagcacaacacgcgacatgcgactcaaaatattcaggcatttactggtatgcactcgactattcttcaagtcaggatagactctactggatagaaggttcaactaccgccaccgcgacaacggcagccacacgcagcggatatcattgttgacgatacaagccaatactgcagttgaaagttagatcgcaaacgacacgataattgaacgttcaggatcttggcgtgactctgcaaatcatctgtcgggcgcagctcatgctgatagagcatgatatattgaaaggctccttttatccttcagctatggaccacggcgcgacaaatctctctttcatttatgacaatgtttccggattttgcagggtataaccgaacctctactccatacaaaacggcaagtggtcacttatgatcatattctggacatacggaggtaaccgattttcgatgtggaaaaccggcacggttaagccgaacccttgaaatcatggttacccagcgcgatggaagctgtagagccttctaaaacggaccattcctcaggcgctaaaagcaaaagcattagtattgcaggaaatagtcgagataaccaagctcaagatgttcaatgtatgtcgcgtgtggttgactttgcccaatgggcttgccttcaatatgccaaactcgaggctaactcgcctacataccgccgctcttcgctctttcactcttaaccctgcgttagacactcaagaccatagagtaagcgcattaggtttgccattgctgcttctgaatggaaatgtcgctcgtttcaacattcttgacagcggactaacaacctcaacaccgcctctctttctttctctgtgaaatggacctcccgatcgcctgtttccgccgaccgcgcagtgcaaagcagacttgcagcgagcgttgcgaagcaccgacctactatgattttgagttaaatcggactttgaatgtgccgagccgacttcgatgaattcatgccgagactgtcaactcacgcacctgcgtgaccgatcaagagaagacgtgtgaaatcaaaaaagttcataaaggaaacgttcttttcacaccgccttcttcttttacttccagcaagttttgtcaatacagtgcttccctgcccttcaagtacaacgctcgttcagatacaatggctctgctcactctagcaacaggagtcaaacggcttttggatcaggcagtcagtaacccaagacgaacaccgatagagttcaccgtccttgctactcttggccttttggtcgctgcaatgatcaagtacccagaccgcgccattttcaccagtgcaagaccagacctaaaagacaagacgtgcaaggggtatccacttgtcggaaacctgctcatgttcttaagcaagaaagagagcgcgctcactgtgttccagagaggatttctgcagtacggagacgtgtaagtcagctaaacatgttttgatcgactgaaaaggttaaggcttcaactgcttaacttccagttcccgttttcacagctatacgctgacaatcccaggtcgagggcgatttatcatgattaattctccggcgctcatagagcatgtgctcaagtgtaagtcaagaaagctgatttggtgtcaccgtatgtaacgttaaagtccttttatattaaccgcccccatcatccctcaacagcgaacttcagtaactactataagggagccatcttctccgacccggtcagcgaccttctaggcaagggcatctttgtctctgaccatgatgtctggcgcttccaccgtaaaaccgcagccaacatatttactaccaagatgtatcgtcagctctgcgaaggcgctttcactgatagtgcaaggaccttttgcttggtgctcgacaggaaggagacccttggcgaagctgtggaccttcagcaactttttctggcattgacgctagatgtgtttggccacctgacattcggactcgagttcaacgcactgctggcggagggtcctcacgaatttggagatgcctacgactacttaacagcaaatattgacaacagactggcagacccattttggtctattacggaaaaaatcacacccgggaaaatgacgaaactcaaggctgctcttgcggtggtggataagtatgcccacatggcaatcgagaagcggagaaacgagactgaggaagagcgagagagacgccccaaggatctgctggaccacttcatcaatcacgtagcagaggacggatccaagttgacggacgaagacctcagagacgtgtttgtcaactttatgatgtgagtgaccagggaccagatgagcattatggatgggcccaacaaaacagtaagatcagcaagctaactatcttcccatagtgccggacgagatacgacagcacttacgctgacgtggcagttctattcactaatggccaacccgagagtgatgaagaacgtgcttaaggaactagatattgttcttcaaggctccgaggtttacagctacgagacaatgacccacggacttccatatcttaaagccgtctttcacgagacccttcgcttgtatcctcaaggtagcgcgtgcttcaggtctttgaatctcacgaacatgtgctcttaagataggaatccagtctaaagcctttttttttttattggccaactctagtccccagaaacgcaaagatggtggcagaggacgataccctcccagatggcacgattgtgcgcaagggcgatatcattggattttcgacctggtgcatgggcaggaacaagtctgtgtggggcatggatgccgagcagtttgttccggagcgatggcttattgagaacgaagacttctctgcggcagctgaaaaatgcgcgctaggggtgagtccctttggaaagtttaaagccgagaaccagcacaagtttaactcgtttaattccggtccccgcctttgtctcgtaagatcaaaactggttgctgaagggaatcgcgttatgagctgccacttcctcttactgacgccgaccgtcttcacttttaatagggccaaacctttgcgactttggaagcgctggttacaagttgcatgttgcttcaacaattcaacttcttacttgtgaaggaccaacctgaacctgaacccaaaccatcggctacactgccgatgttgaatcccttaatggtccatgcaacaagaaaagaagtaagaccatccatcgcgctttaggtaattcgaaccgtgcgtgggccgtgagtgagagatgccaaggatgcacaggctgtggtttctttgcccaataaattacgaagcaagttgacatcgattgtttttttcactctctcgttcactcgcaaagcgagccgagactacaatgcgactgcatcgcaggccatgccgttgggacgcgcaaggactttgggctcttgaagatcttggcaacatcctcagaatacgatgttactgggtactgcatcatagcatagatatccggccatcatttgtgatgtaaacctcgcatgaatgatgaagatgaatggaggaccgcaatggaagggcacagcggccgagaccatgccatggaacaggaatgacatcctcagtgctcgctaaagcatatgagaacgcaatgagggcaacgtgcccatcgtgctttgtttatttgtttgtggtcatagcgaccatttcgtctatcctcatgaagcgagccgaaacgttttctctgctccacacccctattccacagcagcagtatccaagtccttatcaaatataaataatcggacctctacatcccacctcgacaacttcaccctcctttgtcttcccaactgcccacagctctcctttccacaagatgaaagtaaatacgttgtctctagttggcctcagccgcttcattgacaagcaacttcgccagaacaggaagcgttcaccgttcgaatacattatcttgggaactcttggcgtcctcgtcgccgcaatccttaaataccctaacagagcattcctgaccagagcacgaccggacttgaaggacaaggcagtgtgggggtttccgttgattggcagcttgccgctggtcctgcgaggaatcgaaaatcaattggcgtcgatgaatgaaggctttcggcagttcggtaacgcatacaccatgactctaccagtgtttggtcgcatcatttttatcaactctccagagcaggtaatgatgcgttgaagaagaagggaaactgaggacattggagatcaaacggccatctcatgcattctctctccacattgaccttgatagatagaatatgtgttgaaaagtaagtgacccgtcttcaaactctagtttcatttttccatgattcaacatggatacgcgaacgcccatcatagttacacttcttcccacgccatagccaacttcaacaactacattaagggaaaattattcgctgaccagctcgaggacctcctcggcaagggcatctttgtctctgaccaagacgcgtggcgctttcaccgcaagacggcggcaaacattttcaccaccaaactgtaccgtcagttagtacaaggtacatttgttgacaccggcctcgacctctgcacagtcctggaagcgagccgtgccgcagagaggtctgtagacctacaagagctttttctgaagttgacgcttgatgcctttggacaactcacgtttggacttgacttcaagtcccttttggcagagggaacccatgagtttggagacgcctttgactacctgacagccaacatcgacacacgcatcgccaatcctttttggttcatcacggataagattgtccccggcaagatgaaaaagttgaatggagcccttggtgtgctagacaagtatgcgtacatggcaattgaacggcgtagagctgaatctgaggaggagaaggatgcgcgcccgaaggacttattggatcattttatcaaccatgtcgccgacgatggatccaagctgacagacgtggaactccgagatgtgtttgtcaactttatgatgtaagtttgttccattatgcttaacattagccagaaaaaaaaaggtgtgtagagtatgtgcgctaaccccactcgtgcgctacccccaatacatagcgctggtcgcgacacaacggctcaaacgctcacctggcaattctactcgctgttgactaaccctcgggtcatgaacagccttcttcgcgagatcgagatcgtcttgaatggcagtcaatcctatacgtacgaggtcatgatgcaggacctgccataccttaaggctgtcttccacgaaacccttcgcttattccctccaggtaaacacgaaatataattgaatattctcgatgaagtagaaaagtactgatcgcacatttcttttttctgcattactcgttgcaaatcgctcgctcggctcccagtcccaaagaatgtaaaggtagttgtagaggatgactaccttcctggaggtatacgcgtctacaaggacgatgtgattgcaatgagtacctggtgtcagggacgtaacaccgacgtttggggtcttgatgctgagcttttcgttcctgagcgctggctggtcgagactgccctggaaccgcagatgataagcaacaaaagtcccttcggcaagttcagatcagagagtccttacaagttcacgtcgtttaacgccggacccagactgtgcttaggccagacatttgccacactcgagggtctggtgacaacgtgccttctgttgcaaaagttcacgttcaggttggagcctggacagaagccagcggtcccaaaaggatccgttactttgccaatgcttcatcctctaaaggtcgttgtagagaaaaaacacggcagcgtagcttcttgcttgtagggtctactactcccaacttatcgttcatcagtaaacgagatgcgaatatatttttctctttcttggtactccgtcaacaataaaagtaagagcagtcgccacgccagatcaaaaatgggtatagcgtgatgtttaggagcagacctttccacgacggtcgtgattgcttctgggaacacgaattggctagcaggaagcaaccgaccactctgtccgtgctttcgttcgctccgcctccaaaggtaatttggtttcagattcatctaggaacaaaaaactaaataggcgcaatcggcttaaccatgtccgatttatgcatttaagcctcaccatgcccttgaagttggcaggatacgctagaagcgctccaatggagcagatgcatggcacattaatgaggccttcagaacaacaagcgatttcagccaattctccgatggctcttccaaatagggcaacgattttctccacaccttgggagggcaagttcggaggcgaaaaaaaaaaatacaacacagcagccgccttccaatcacgatgagcgttctactcttttagacaaggagcaggggaaacaaaaggtcaacagaggtgtggattggacagctgagagccttcaaaacatctcttgctttccgacgacagggacttactcacgcctcatttaaaagatttcccacaacttcccttcagcgttgtatgttgtcattgcagccgagtataccggcggaaaatggaactgcatctcgatccgcaggtctttcgtgaacgcagctggcctctatgatggcgacgtacacaccctataaataggaacatcagcaaggagatcggtcagcagaatcaaggacttgcgtcctttgcgcggctacgattcacgacttgatttggaaacacaataatgataacaaggcagaatgtctaaaatggcttcaaaaaaatgacccgaaaggaccaggaacgacaaacaaaggagaggagaggagtcgtaaaattagccactggaagcatgaggggagcctacgtcgtgtgcaccacatttgaatgctgtcgttggtttatgtagaagcgggagcgctattttgccgttttgacacatgcacgaaataggaagaacgttgcgatggggggcttgcacaacaatgctcgcctgcgccggaagccgcgttagacatacaaagaatcggtcgtatggtgaagtgtgaccctttagcagaaaggagggaattgatgtaccgtagccaaatgtccacgttcgagaagacaggtgtgttcgagcccagaacaactcactcggccacaagaagagccgaggacgggagctatgtgaagacgaattccagcgtaactggtggaacgaggttcttgatgagagagagacctttctggctagctctccgctcaataccttaactctgtcggatatggacttgaactctatatgaaatgaatggccatgtaaaattttcagtgaattattgctgcaaaccaccatacagtcttggaacgaggacacgcagaccaaggaacacaggccgttcaacgcttttccaaatggagagcatggaggaccgagaacccgagagcgctccaaacaaacccttctcgatcgcccattccaaccccctgcacaatcatagggctaattacgacgtacggtttaccacgctgtttcctttgtttgtcttttatacacataccgtcattctttcttctctttccttccctcttcgttcctcattgataccttacttcaaccccatcgtcttccccatctgcgccgtcaacttcctgcttctactctccgattcagcacccatcatcttttgccgctgcatatatcacacctcgcgctgatttgcatcccacttgcgtttttgatacccgcactattcttttacaacacacttcggcaggactactcaaatactcacaatcaaccgcacctagatgggactcttcaccaaaatcaacaagccgctactcgctgggcattatgaaaatgaagatgtacagattagtgcagagctctgccccaacatcaccatttacgttgttggtcttgcaaaggtaggtttacttcggcagttcacccaccgcttctgcttccctcaactctgacctccaactcgtatcatttttgtcgtcgttgtgaggtgtttgcgttttctcttgggtcatgcatgtccgtctgggggatggttccagctttctaatggtctcgggagagcaatcctaagaagtgtttatcaattgggcatcgggcattaacatttttccacaagtgcacccgagatcggccaagagctgggctattttgttttccaatcccgatccctagcattcagtcttaacgcagtacgggcaccccatgcaacatgcgactccctcttgcttttactttggccgcaacgccactttacgttcgatgctctcgggcgtttgcttgcctagcatctgctgtttgttgtgccctagtcatacatgcattcgtttccttctctacctggctctctcctcccccttgaccaacaaacagggcattttgtacacatgtccactctgtcgtcgtgttgcgttgacttgcggccaaccagatttcgatcacattattctgcggaactcgccgcactatttttttttttcgtttgtcattctgccgccaaatggcaacaaagcaatggcttgggccgggagttagtcctaagggcacctcctctgtttgctgcgctttgttgatagcgcgagttctacagtacagtacagagtggtcgtgttgacatatgcggcggcgttggatggcgtgtcactatagccctgatcatgcttctaccttttaagggtacatacaaccaccaccattctcgacggaccatcgatatttgttattggagtctgtgtttttcaagctattcgctcaaactctttactcaagagaggagagcattcaatcctatctgcttatggtcataataaccagtttttctctggaagcactgtggttgcaatcgctctcaacccttcgtcacccacccttgcgagcaccgtgaatcatccagcgcctgcagcactgtaacccattgacctcatttccaacaaacaagcaacatttctacacgctctgcacactgccgccctagtgatctctctgcgcatttgtttatccagctctcaatattcgtctccctgaacagagttccacctgtagcagcttgtccggttgttattactttctcgtttttcgcgccattgctcaaacgacagcccctcccgatgcttcgatagacctagaccttggttctttggttgccttttaagtgcaccattgctcatgacagcttctgctccgagaattggagctagccctgtcgctcacttactacactatcatttgtgcacctcgtagtctttttcccccggataattttcagcgcgttcatgtgtttgtacattggtcaggtacatgttacccagctgaaatcaaaaaaagagaccttctcccgcaaggggccagagcagcgtgctgtgagcaaggcttgcgatctatcttggtgttgcgaaggttgagatcggggggctgggtagctccacgcggcatacatcatccagatctttctaggctcaaccctcatggccttctttgtgtgacgctcaacactctggggtggggaccatgaagagagcattgtgcgcagagtcaccactgacctccctattcaaatcctcctgtgcgaatttgattcccttctcttgagagcctccttcttggctgttaggatggttggggcttcgcgtttggatcaaagtaacaaaaaggtggcatgacccaagagcgctggcaaagaaaaatcatgggttgatggcactgtaaagggtacacgagcattagtaggcgtgtgaatccaagtggagcgagagtggacttgtccaaactttttttatttttttatattgcatttgcgccacaggagaggactgaggatccactcgataattcaggaacagagcaagcaagggacagtgtctgtcagcgatcgatttgtttgtgacacacagccccattctctgcacgcgaaacagaaagccgttgtctttgtccataaaacaataccccatgacagctccttgctactcgagtgcagtgctcatctcctgcttctcctcctcctcctcagtctacatgatttctgccactcagtcctgcctaactgtatgggcaccctcaatccaaggcgcatgttctaatcaccctctcattttttttgttgaaaaaaaaacactttcaaaaagggcgaggtcacaatacttagcggaaatgaggatatggttcacatcaagaccagcgttcaggcaaaagaatcgattctcaaaaatgccgcagcactagagccagtccaggatggggacaggtacacttacacgatccacacgccgcttgaggacaagctggagaaggccgtagccttccaggtttttgtcaccattccgcgtcagctcgacagtctggagtctttcactatccagggcgccaatgtcgagctcgccatcggcaatatcagccatactttcatccgtaatttgaccattagcaattcaaagggggacatctctatcgatgtaagcacggatggctttttctgtgcaaccaaaaccgcgccgcataaaaatgttcaatcatctttttgcctaacactgcgatgtcgctcttcttgccttagaacttttatggagagtcggccaccattactagcacaacctcgggcggcatttctggcaagtatagcgtcgctcgcctcgtcgcgactgctaaatccggccgtatctcctctgacgtccatcttctcaacacggatgaccaactgccctcacccaaagtcatatgctccgccaccaacgctcgcgttgacctgaacgtcgacggcagcgatctctttggaccgttcacagtcgaggccaagactcagtgcgcgcctctggagaccaagatccttcttgcaagcacggaacagaggttactgggcaactttatcaactttggaggaccgacgcggatccgcatgtccggcaactttcaaggacgaattgaaacacgaacacattatggaaagatctttattgatgagcccgagtttgtcaggctggagggagcagtcttgacgataccttcgttgagtgaccggaaaacgaattcgctggtagatgatgcgataggactgcctcctcatcttcatcatcatcctcaacagcagcgccagcagcatcagcatcagcgagcgaacggcacagccacaacggcatccacgtcctcggccgtgtctcaccactcgaatgtgatctcgtctcggacctcttctcaaggcacgtccatgtcctggggagaaaaggatttgtcaatgccaccctcatcctatttaactggttttcacacccatacccatgacggtcacgttgactatgaatcacccgctcacgcatctcatcctcctcttcctctttctcgtcactccaaccctctacctccaccacaacgtgctaaccatggccgttataaccctactccaccttcttcagctggctcctcctccaatggctccgattctcactcaagagccgagtccatgacagggtctttgaacgagaaccggtcggtcaatggcggtcccctctcacccttgtcctcgtccaggtcagagaagcagaggaggaaggatgaagaaaaggattcaatcgtgacgcgggagatgattgggaccattggtcagggcactggcttgatcatggccaagaacagcagtggggacatcacggtagagctcatctaaataaaaaaaaaaaataaaaaaaaaggcactgttgggtcccataaagctcatacaaagaaaccatcttgtgagaacatggcactcgatctcttgtcattcaaaaggctggagataatgacgccgtattctgcgcattctgctggcaaacgatagcgaatcgcgatgctcggctttgattgcccgataaaggttgtttgagttccattctccacatttcccttatcatttcaagatatcgactggactggacgtgtttttctttttttatatatacgcgctggaatgggtttcacagtcagcttttggcaatcacagcttcgcaaacgcgggaacgagacctgcatacaagaaagatcggcgtttgatgcttatctctcgccctctgggtggtctcattaggtttggaccccaagcagagcgattgcaacaagataaccgcctccactcatccaaatccctgatgcatcacaactccatttgtgtcccccatccacaacgatctttccgttccacgatttgggcagtagagttgtactgtgcgattagagtgggcttttatttacaaagagagcattttttttttctaacaaatccactgtcctttttgtctaaaagagatgggaatttagtggtccttggagtgcatgtactggatcagctcaacgacacgggtggagtagccgacctcgttatcgtaccaggagacgagcttgacgaaggtgtcggacaaggcaataccggccttggcatcgaagatggaggagtgggtgtcaccaatgaagtcggtggagacgacctcatcctcggtgtagcccatgatgcccttcatctcgttctcggaggccttcttgatggcagccttgatctgctcataggtggcagggctggcgagacggcaggtcaggtcgacgaccgagacatcgggggtggggacacggaaagccataccggtcaacttgccgttcaagtcggggatgacctttccgacagccttggcggcaccggtggaggagggaatgatgttggctccagcaccgcgtcctccgcgccagtccttggacgaaggtccgtcaacggtcttctgggtggcggtggtggcgtgaacggtggtcatcaaagcctcggtgatgccgaagttgtcgtggatgatcttggcaagaggggccaagcagttggtggtgcacgaggcgttggagacgacctggtactcgggcttgtaggcatccaggttgactccgcagacgaacatgggggcgtcagcagagggggccgagatgacgaccttcttggcaccaccgcgcaagtggagggaagccttctcaatggtggtgaagacaccggtggactcgacaacgtactcggcgttggcagcaccccactggatctcctcgggcttcatgctacaagataagaaagagcacataccgtatccgttagtcaatcagtcaggagtcgctatcatcagatctcaattcaaagtttctgggacacgatttctgcgctatctcactcagagatctaacttacttctggtagacaatgatagcgtggccatcgacgaccaagtgaccgtccttgatggagacctcgcccttgtagcgaccgtgggtggagtcgtacttgaacatgtaggcctaaagtgcagagtatcattcatagaataaacatcatgtacggtgagccactcctctcagcagcagcccgtttggatcctgtgtatccccagccctgcacgtcggtccagcatgcagcaatcaaagaaattgtcataccatgtagttgagatcgatgaagggatcgttgatggcgacgaccttgacgttcttgttggcaagagcagcgcggaggacgagacgaccaatgcgtccgaatctagaaaggtgtgcacaagcagaaagcgtcgagggacgtgtcagccgatcgtctcgcacttcgtatgaatatcgcgaatgggataactgttatcggtagacagagaggttcgtgaagaggggggctctggttgcttgctcccaggtcaaagagccgagatgcacaagcgaatgagcaccaggagttctttttcaagtgagtccatcagaacgcggatgggagccagcagaaccagtatgcaggaacgcaaggtgcaagtgcaggaggaggaggaggaggaggaggaggagaggaggcagcgggtagaacaaggggcgggagagcgcgcgaacgagagaagggaagcacgagagcacgaaaggcacaaagaagccgagtcaacctacccgttgataccgatgttgatagacatgttgagggtgtgtgtgggagtgtgttggggttgaaggaagaaaagaagaggaaagaacaaaaaattcagccgccgtatttatatatggtgctgcaccctgtgccgtgcctgccctgtgtcatttgccgtgactggccacccatcttccacccacccattctttcccaacgtcattaaggcaacggtgcgcggaaggaggcaccaccacctcctcctcctgctccccctcctcctctctcaggcacccaccccctcgcacatccatcgccgcctcctctcatcactcccttccgagtcctactctacatatgtacggcctcatgagatatcttcccactcgcgctccatatgatttcgatcccggtaccctccttcgtcaagagcgatcaggtctcctcgtgcaaccgtgcgctttttttttcacctgtgtcctacccgttggatattcaatcgtctgacgagtgattgcccctctctcgagcatgcagttgccctccaacatctgccctctgaccaacattcctccctcatatgtcttactcttccgcaagggctgggagccgcaagaggtaaacggccaaacaacacacaggaacgtgaatgagcatcggctccgtagggtgcccaaaagaggcaaacccgcattttctttttcttagtttacatcgaactttacttttctttcttgccattttccattcggcaataatgcccacgggcaacaattacttgcctggcccgcgtccgtctctcgccctccctccctcaactcgctcgctttgtgggtctagcattgcctgctacccctcatgcaaaaagtaggaaccggtctcaatagagaaccccattttgaccgagtttttgcgcgccccctgcacattttgctggggggaggagagacaaaagtactttacgagaaacacattgcggacagacaaagcctgggaagaaaagggacagctgagaggagccctccccccctccgatctttgctggggggaaatatacgggtgcccgctgtggcccggagtgtcgacacaactgccacacaggtacaggccagagcatcgccctcccacttttccccgcattttagctatttttacttttacgcttctgcagtagtcttgtcaataacacatgcactctgtagaccaaggcatcttgttcatactctactgtatttcattcccgaggggatcaacggcaccactgcaacagtgcacgcactttctcattcctcaaacgcacagaaataataatagaaaccgccaagcaaggggcttggttctgcgtgtgccatgtaatgtgcagccacatatctacaccgcttggacttcaaacttcaatctcataaaccatcgacatgtcaattttgtattaacggaatgttttgttctcatctaagcttggttatgattcaaaggaaaggcaccgggaacaggaaggaaaatgtacaaaacgcgggacttgatgttcaaaccagtaaaaaaagcaaaggtcataaaaacgagaaaacgatcaagaaaagagagtgaacgcgacagcagtgagacgataaaatcaaacagaaaagtggacaatacaaaaagaaaaaagagaaaacaaggaacacaaacggaaggagagaaaaaaacgataattcgacttgagaaaaagggtaacaagcaaaactaacgaagtgaaaaatgaaagagatggaaaaaaaagagaaacaaaaaaagaaaggcagggtgtgaaaaaagaaccgcccgagcacacccgcgcgactctcctctcgagttcgcatcagacattcaccctaaccatcgaggaaaatttatttcctctagttctgggaccagaactgctgctggttgcgcccagatccctggtgctgaccctgatgctggttggggtggtagccctgatggtggctggggtactggtagttggagaacatctgctgctggtagtatccctgctggctctggttggcattgcccggctgctggctctggagcgacgaggcaccgccagccatctgagcgttgttagtggactgcgaagaagcagaagcgttcttatcagctcctgtgtagttgctgttgccagagctggccttggcgctgttggcgttggaagtggacgtggctggctgctgctggttgcccaagaagttctgcatgccagggttgccatacttggcataggggtcgttgttcaaaccacccattccgtgaatacctgcggcagacatgtcctcatagccagcctgcgaatactgatgatgtccctgaccggcagcggagctgtagtttccgtaagatgagctgttggctactccaggcttgctggagtgctgctgctgctggtgttggtacatggggtacatgttcttgttcacaaagggctgaccgtatcccgactgctggtagttggggaactggctagggcccatgtagtagtatgggtagtagggcattccagcggccatgttagggtacacctgctgctgttgctgctgaagagtttgctgagcctgggtggtaccggttgtggcggctcctgaagtgctggtagtggcggaggcatcctggttgaacttgctgtcacgcgactggtagttgctggcggccgtcacggggacctgaccataagtggcaggatcgtagtacatggcacgctggagatcatttccatagagagcagcatagtcgtttggaagggaggccatgggaggcataccaaaggaaccgagctggtttgcagggttgggcatgtacgagccatagggcgagcccatagcctcagggcccataccgggatggtggtgatgctggccaaggtagttggcggcgggatcctgcttcaagtatgcagcgttggtggcggcaggcgagagaccgctggctgctgcaggagaagtgccctggaatcctgaggctcctgctggagggttggactggcgagcgtaggcaggctgttgctgttgctgctggggttgctgagagggagttgtaggctggattgcagcaggctgctcgggctgggcaggctgggcaggctgggtggtctcgggctctgcctcaggggtctcagaatcatcgttcaatgagaagctaccaaacttgacaccgacgctctgcaaagcagaggatccgctgggcatgacaacaggtgcatcttggttcaaacgacgggtagcaacagccttgggcttcaatccaggtggtccaacagggatgacggccttgggtgaagcgggtgcagcctgagcaggctcagcctcaacaacgggttctggggcggtgatgggttcctcggacttctcctcgatcgcctcctcagcaacctcaggggcgggcgcttcgggctccttctcctcagtgacgggggcaacaacctcaggagtagactcaaccactggctcaacaatcttctcggcttcaggtacaacgggctcaggggcgggtatattgacaggggctgaaggcacgacgggagcgggaacaacgacaggctggggagcgggtgcaggtctaatgaacacagagttggcgagtgatcagactaaataattcaaacacaaagccaggccgctcatcagcaccgctgcatgctgaacttacttgacgatctttgcccatgacatcttacttccggcagggatggtagcggtgtttaccttgcgggcgggtgcagcgggtgagggggctgcagcaggggctgcggcaggggatgagccccatgagtcattagtggtggtggcggtggtggcagtggcgggggctgaccaggcatcagccgtggcagcagtggtcgtagagtcgttagtcgtggcggatgctccccatgcaggtgctgatccccatcctgcggtggcgtctgctgtagactcggctgcggcagtctcgccgttctcagtcttctctgcgctaggaatttcattctggctctggtcggaaactgcggtgatctctgtctcggccttgatgggaagtccgttcctgtctccgccgttcagggcgcgaggagcaccccttgtcgcaccgccgcgtccgccacgggaggaatctaaaggttggaacgttagccactggtagcgaatccgccattacaaacgaacaccgtagaggcatgcagcttaccaccacgaccacgtcctgcgaaaccgccacgctggctgttagaagagcggaactcttgcttctcagaagcagtctttgtcttgggcgtcttcttctttcccttgacctcaccccactgagtagcatggcctagacaatagaaaaggtggggacttagttggcttcgaatacagcaaccggatggcattcctagccaagccaactctgggctgcgcgaccgttggtcgaggctgatccattcattggctgtgcgggcagccccctgtgcgccactcatattcaacccctaaccctcagctgtatcactgcccgctgtgtgagtatctgctcccttcatcctccggggaacacaggcgaccccaggcgctcccgaaaggtgtctgtctcatatgcctatgccaacaagctcaaaagcgagtaggaacacagcccaaaatggatagcgaaggcttcatcgctccgaatcaaccactcacggggctgccacttcaagaaagtacgaggaacaaaggggagacaggtgatagagtggaggagacgtgggcaacgcgaagggaggatggggtccaaagcattgttggaggctacttaccgtcactgatcctgaggatggtaagctccaagtcaccaccagcatcttggatggcgtacaaaagatcttcctctgtccagtctgcaaagagctccttcaatgtaaccagcgaggcgccatgttcttggcgaagatggcgaagatcctctggttcatctttgcgtctctgtgaattgctatgaaaggttgccattatatctgagagttctattgattagcataatcaagagccgacagacagccttgctgatcagggctccaggaggctggtgagatgacgtttcctggctggtggcgtgacgatttgctcagctgtgttattctctgggaatgcgcgatggtccaaatgttgggtacgagattggcatccccggtttcgacggtcaaagacccgtgtccaagccaaggatgagcatgcattgcaagagcagtgctttgatgagggctccagcattccagtgttgtgttgtggtggttttatggcgggtaaaaaagaaaaaaaagagtcgagtggatttacctcttgtatatgatgggtgggtgctgctgggtgcgtgtgggagcggattgcaaaggcgtatgcgggcaggatgtgtcttgggtgagggctgggtgtcgacaaggggggggatgggtgtctgtgctgagtgcggatggtggttatgaggaaatgcgaaaaaaagaggaaacgaaaaaacgaaatcttgataaggggaccgcagggcgagcgaggtcccactgtgcctcagtcacccctgcccagccagccagcggcgcgtgtaaattggctcgaagggcataaacaaatcgtcggtggcttggcctctggtcaacaaaaacgacaagacccaaaacctgcgaacccaaaacgaattgacaagcaggccaaccatccgtctttccattcgctctttccctcttcttctgctttctccctcctctcgacacatcactcatcatggaggcgccactggacctgtcaaagctgcatgctttgtcgcctgaagtcatttcaaagcaggctacgatcaacatcggtatgacctatgcccttttcatgacccgccacggactcctgagtgttggacgtcacagagctacagaggcgcgtatggcaaaggaggaaactcagcatggccctgactccatgtcttctgtttgttgtaggtactatcggacacgtcgctcacggtaaatcgactgttgtcaaggccatctccggtgttcaggtacaggatgcaaagcaatatctggaaaggatggcgcatgcgatgtccaaatgctcatgatactcaaagaaaaaaacttctcgggatcttcttgatgatagaccgtcagattcaagaacgagttggagcgtaacattaccatcaagctgggatatgccaacgccaaggtagctaccgtggcgtggtcgtggaggagggacggggtgtaacattttttttcgacgctgctatgtgggccacgcagctaacggagccagaacgtctatagatctacaaatgccaaaacgaagcctgcccaaggcctggatgctacaagtcttaccgcagcagcatggaggaccaccccaagtgcgagcgtgcaggatgcggcggtattatgaagctggagaggtcagttttttaatgccttcccatatgagtcacaatccctcatttccaccgtagcagcatatccttggccaagccagtgtgcatgatgacgcaaaaaaagcctatactgacgcgcatccttggttgtcctccattcgactctctagacacgtctcgttcgttgattgcccaggtaagaaacaaattgacaaaggaaaagaaaggagacagttgtggactgatctgagcacgaattgacctttttgcgttcattgaatgaataggacacgatattcttatggccaccatgttgaacggtgccgcagtcatggacgcagctctgttgctcgttgccgccaacgaatcttgccctcagccccagactagcgagcatttggcagctattgagatcatgaagctggagcacatcatcattctgcagaacaaggtcgatctgatcaaggaatcagcagcacaggagcactaccagagcattctgcagttcgtcaagggtactattgccgactctgcccctatcgttcccatctctgcgcagctcaagtacaacattgatgctgtcaacgagtacatcattaagcgcattcccatccccgtccgcgacttcacctccgatccccgtttgatcgtcatccgttcctttgatgtcaacaagcccggtgcagaggtcgagagcttgactggaggtattgctggaggatccattctcagcggagtgttgaaggcaagtgtgatttccaagtagtagcgcccaaggcaataggtctcggagggcatgaatggtgactggaattgtctaacactcctatccaacctgacactatttagctcggagacgagatcgagatccgccccggtattgtcacaaaggataacgagggaaagatcaagtgcagacccatcttctctcgcattgttactctcctggccgagagcaacaacctcaagtttgctgttcccggtggtttgatcggtgtcggtactaagattgatcctaccctctgccgtgctgatcgcttggtcggtcaagttttgggtgctgttggaaagttgcccgaggtctattcggagctggagatcaactacttcctgctccgccgtctgctgggagtcaagaccgatgataagaagcaggctaaggtgactaagctgaccaagaacgaggtcctcatggtcaacatcggatcgacttcgactggaggacgtgttatccaggtcaagaacgacattgccaagattgccctcactggtctcgcatgctcagaggcaggagccaacgtcgctctatcacgtcgtatcgcaaatcattggcgtttgatcggatggggcaagatcacccgtggttcctccgtgcccatctaaaagcaacgatacggttgcaaggatatcaacgagatagagtatcgctgggtagtcatggtcgaaaggaaggcgagaacaagagatcgtagtaaaagaacatcatcatttttgcacattgaacagttttagtgctttgctaaggttcctgtcagtctcgcagctcgaaacaacgacagcttttttggtggaaggttccggtcatccacgacaggctccatatcctccgcatcctgaccttcctcctcgtcctgttcgtcttgttcatcctcgtcatcttcgtcatcatcgtctaggatgtcttcgccatcttcatgggtgtggacttgtggctcagggatgatcatgccgggaggaataaccacttgctgctcccacattcgctcgatatcttcacgattgaagccgccatgtttggcgatcattgcctgtcgacgctcctggtattcactaaccacctacgagtgaaaggaagattagaacaatattttcaccttgacttgaacgcttgcagcacctgcattagagtctaaagacaatacctgtcgcattaacatgtcttcctcgagctcatcctcatccacaggctcaatgtcttcatgctcaacaactgcgcccttcatgagcgcagtgtccttaagcttagaactctctacgacagggatagaacgcatagcagggacccctggcttcaggctcgaagagggtgccctggacgccgctggtagtgacctctcagacacaaatccaattggagctttgttcgcaacagacaccgagatgacttgaggcacggatgatcctggatgcactgtagcttcattcatgtcatcctctgaatcagatacggcatcaaagctggatcctggcaccgcgggctccggctccaggtgggcaccactttgttgttgctgctgacggaatagagacggcttcttacgtccgctcgttggttgttgagtagtggctgtcgagtccattggcttggtgaaagtgttttcgatcacgtccttgatgcctgtgactgattgaggggctgaggttattgctcccttggcatcttgaacaatttcctccttctcggagacctctgatagccctggtgctgccgactgctttggttgcaccggcttgacattacgctcaaacaccatctcagagacacctcgaagagcaggctttactggcgttggcgatgaggcctccgtcgatgatgctgcagatgaactcatacgcgactgtgcgaactttgagagcttcttggggggaatgtccttcggctggtcgtcggtgggtaggatcgccgcggagccagttggctcctggaccgcggtcggtgccgctgctctcgactgcttaaaccgggagactttcttaggagtgggcttgagggccgatttcagtggaaccgctgtatcatcaggacctgtcgtgggagttgcctcaaacacaggagctttgtctagaccgttcgaaggtgtcatcatgttggcgaacgtagactcgagattggacatgttgaccatcggtcccgatcctgcagaccgcactgcctgctgcctgtcccgcatctgattgtataaatctgtaggcgactttggcttcacactgctgcctgaagaaggagcaacagtcttatgcttgttgatgctggatttggtggccctggcaacttgatccgcaaagcgaacggattttttggacaaggacgctgcgttgtcctttccttgaataccaaattcctcatcgtcctcgtcatcttcgtttccggagtgttcccagacctcctcctcatactcctcgtccgaatccagcgcctttggtcggaactcgtcctcgctctccccatcgtcatagtcggcgtcttcatcctcatcagactctgtttcctcatccgaggtcacgacctcgccggcttcacgacggcgctcccgctcttcatcttctcgctccaactctgcgattctgtccagaatggcgcgatcctcagcctgctctttgggcgtcttttgggagaaaggtagtagtccaggctggtttgctttgacatccttgtcctcttcgtcctctgagtaatacggctctgtgatctcgacaatgggaagtccctcttcattatactgcgtgtcatcaaacacacaaatgattagcgagacgatcttagcctttgagtgtcgaataacaatcctccgtcatcatgcaagttgtgtgtcacctacctcctgccctcccaagagacctggagccatgccgctcttgttgcgaatctcgtcctcctgggcttgaagcttcgtgatgttttcctggacgactatagtgcagtgagttaacagagtgaagagcttagtaccaacgcaagtcattctgtcctctagcaatgccaagtcatagacttacgctccatgcgtctgtcgactatttctgcagcttgaacggccgatcgatccacgaaccagttgtcaccaagcatgaccagtacttcattggtgtgaacaagctttccgggcatgaacgccagatttccgactggaacctaggaaagtcgagacagtatttgttatgtcagaggcgcttgcttgatatcggaccatctgtaggcactcatccgctacgcactacctcctatcacgtaccatgacagggtgggaggtttccttaggaaggtcgagcaaagtcgtcttaagtgcttggtaatcagcttcgtaattcttccagcgagccaattcctcatccagacgtgtcaacgccgcagagaactttgagaagtactttgcaagctcagcagcctcagcttgacgatcggcgctctgtgagagatccatggtcgaatgcaaatgggcagaggcagaaagagaacaatgggcaggataattttttgtttcttgtgaaaaaaatacgagccggtcacggcttttttggaggtgttcttccgttttttttttttgcattacctcactgctctctctctcccactctcgctcacaccctcagttcccgctctctttccgacacatcttcctctctccagccctgttcctttcatttaccctgcttctcgttacaacctctactagctacctcacagtcccaccatgggctcgaccgacttatccaacagcagacaggacagcagcaaccctcgctgtttcccgaacacagctgtgccggatgagtctctcgtttgcagaaacactcgagcgaatgccaggtcgaaaacattctcagaccctgcttcacacagcgccagacaagaccatacccccattcgaccaggcacagcctgccgtcacccttcgtcgtcgctgagcaggtccgtgaacagggcgactgaatggctgcagctgctaaatctggccgcagtagatgccttccaccggttccctgccccaggagggcccatgctcctcactcctctgctcgatccccgctacagcagcagctccggtaaggacgaatgcatgtttgaatgatttgaacttggccaaggccgaggatgtggccgataagcgagcaaaaccattgccacgaactccgccagactaaccaagccatcatgctctattggttctattgggtcttcctttgctgcacaatccggctcttgggcatgccgtcttctcaggggaccacaagcgacagcgactagtcatgtcacctggcatcctgtacttcaaccaggggaccgaagaggccagtcgccccaaggccgcgatcccttcttcccatgcagccgcttcccggggtcctcaggcccactccccttctatcaaatccaccgcacagagcagcaacgcccccatcccgaataccccctttggtgcccctaccaagcaagcccggcaactgtccgacacgcaaggctcatcattacccaacgccacaccatcttcccttgcgccctcaccagcacactccacccactctcgctccaccgcagccgcctcctcaaccatcgcctcagccagggacagtgacaaaggtaactcggaggggagcaatgcctcgcacccatcgtcctccgcagggagatccgagcctgcggcaacaagaggcccctccgcctctgttggagcaggatcaacgacggcactcctctacaccacaagccaagaatttggtcagatttggacccaaaccacggccttcctgcatcgcaccttctcacccacgtaccgtgtagggagtttatatttggactcgtggactaatggcacccagaaacgaggactcgagaggctaaaggctagccttcttcggggtgacacgtttttgttgatgcgaaacactaccttgcagcttcgcgacctactgaaaaagagcatcgcggtcaacaaagcacaggcagcggatattgagcgtcatgcaaagacgatcgaggaggcgcggcgcttccgtcatggccagggcgagctggaaaccgggaaagaaagcagcacatcaaccccttcagaagaggaggagtgcagtggccgcacaggaggagatggcggcggtcccagtagctcgtagtggtcactcaacacttgtagttatatttgtaaacctttttgactgttcaacactagaaatgtatctcgcagagctgcgaacacgaaagcacgacgttaggatttttaacgcactagaaccgatcactaggtcattggcagacgcggaaaaggcaaaccacgcttaccagttcctccaatatcgcttcctcttcctccttttcacgctgtttctcactcttttccccattgccatccttgcagtcttttctgcgtttgtcctctttgtggcttttacggtgcttatccttttggtctcgtcgagacttcttaaactcctgatcataatactcaaaatcatggtcatgacggtagtggtagctgacttcgggagcaggatctggtaccgcaagatgcggttgatagttggaaaatgcgtggcttacggaactgtatggcgaggtagcctgccagacgtgtgcaggttgagagacgagcgagagatgtcccgcagcctgcagagcgggcacatctggaaactcccattggaattttcctgtgctagactctatatcacagtgccacatgagcgctttgcgctacttctgcctccagacatacggtgtcaaatgggtgtcttaccgacgtaataggtcttttgcatcagtggatcataatgggagttcctaggaacgaggtgcatgatatttgagcgtgagctgctgagggcaagccttcgttgagtgtatcgtgaccatgactgtacagtgccatcttggaggaggtggcagggtcatggtgcttagactaacaacttgtgctgcggatgctctgagggttgtgaataaaagattgttgttgagcaaaagcctggctaccgttgtattcttatacttgcgaaggcccttgatcccgcggaggggtgcgttgctgtagtggctgtgctggtgaagtgacaacaccatgaggacaggctgctgtcctttttctttgcctcggttcatgttgttcaatcatttggtgagtcgaggaaattgaccggctggacgctacacaaaagcccgcgccaaacgccggatgctatcccattatgattcgaatgccggtttcgtgcagaagtgatgcctgcttcttatggttcctggtccctggagagctgcgcgtgagcttggcagttcgatctatcgtactacgaacgacctgatgggtctgtgcgctgctcatatttctaaagtccaaacgcagccgttttcaaaagagtgagtcagggcagaagggatccacgtgactcccgattttgcaacacaaatacacattttttttcttccctctgcttgatattcttcttcgtctctttattcatcacaaccaccattgatcatggccgacaaattacccgtcgattccctctccatcgcttccggtaatcattgtgtgaaagaagaagagaatggcgaaatacaatgaacagtgaaggaggcgagattttcttgcgaacctgtggcaagcgaggaacgaacaatgcaaggacttgatcttgtccttttatcaccagacccaaccttcaacccgcaactgtggagaaaaaatgaacagaatgaggaggcaggcgggaaactttttgaggagacaagagtgcttcgtgtgcagcctcgcgaaacgctcccgacttttttttggcttgtatcgcacattcgcggcatgttaactcggatcatttcgctcccttgaaatacgctgacgatcttagttgtccacgttgacgagaccaagggctcggacgagtctggcaacggctcggttgaggctccttatcagtctgccgccaaggcccttcaggcccacggcgagtctgccaagatccaggtgtggaaggctgccgccgctgagggcgagacatctggatatgcccccatctctggcgctgccttgaagaaggccgtcaagaaggtcgctgagctggagaagaaggctaagaagctcgccgagcaggctgctgagctggctgccaaggaccaggccgctgccgaggagcgcgagcgtgttctggaggccgccaagcaggttgtcttgaaggaggactcctccctgcccaccgccactagaatcaagatcagaaacagtgtcgagaacagaggcaagcgcgtcaaggtctcgggatgggtccaccgtcttcgtgtccagggcaagaacatgaccttcatcattcttagagatggaactggctacctccagtgcgttctcactgacaacctcgtaagcgacattgactcatgttgtatggttttgcgatcagtggtctacctgaaaacgagcttgcagttgacatttaaatttgccttgttgtatagtgccaaacctacgatgctctcacccttacccttgagtctaccgtcaccgtctatggtgtcatcaacgagcttcctgagggcaagaccgtatgtgctttgacaagttacctggaatatgcattggaaatgaatctggtttgtgtgctgaccgatgccgtttcatcctttcacccttattcaggctcctgaccaccatgagttgaccgtcgattactgggagtgcattggaaaggcccccggcggcgatgaggccatctccaacaaggtcaacgagaactctgacccctcggtcaagtacgatctgcgccacttggttcttcgtgaggaaaaggcatctggtatcttgaaagttcgctcgcaggtcatgaaggccttccgcgaccactttgataaccgcggcttcactgaggtcactccccctgccatggttcagacctcggtcgagggtggatccactctcttcgagttgaactactacaacgagaaggtaataacatctgtgattcacaacagcatcgatagagtatcgaggggtgctacgttttgcaagcaatatggataagatgactcaacatggatacactctctctcaccgatacatgtaggcctacttgactcagtcctcccagctctatttggagacctgccttccctcgctgggtgatgtctactgcttggctgagtcattccgtgccgaaaagtcgcacacccgccgccacttgtccgagtacactcattgcgaggctgagatggcttttatcagctttgatgacctgctcgaccagctcgaggagatggtgtgcgatgtcattgaccgcacgctcgctcacagaccctctgccgacattgtttacaagctcaaccccgactttaagaagcccgagcgccccttcatgcgtatggactacacggatgccattcaatacctcaaggacaacgacatcaagaaggaggacggcaccttttacgaggtcggcgaggatattcccgaggcccctgagcgtgctatgacagacaagatcaaccgtcccatcttcttgtgccgcttcccagctgagatcaaatccttctacatgaagcgctgccccgagaaccccgctttgaccgagagtgttgatgtgttgatgcccggagttggagagattgttggaggatccatgcgtatctccgacctcgaggagttgatggctgcctacaagcgcgagaacctcgacccctccccatactactggttcactgaccagcgcaagtacggaaccaccgagcatggtggatttggtctcggtgtcgagcgctatattgcctggttgttgaaccttcacactgttcgtgatacctgcctctaccctaggtaagatctcaaactttcgtcagcgaatgattttgcttcatcgcgtttggttccctgtttcaccctctaacacgttcgttctgtatgatgtcaatagattcaccggtcgtgcattcccttaaatctttttttcttgtgatatctatggctactgggaacagcatttttcgaccggcagtttttttttttcttttttcacatcgcttttaataataaactgaccaaaacgtagaaccgctcaatgagaggaggcactttgcagtttatctcataatcccatcagaaaattggcaagtacgctatcgcccgttccaccggcgccactcccagaatcagaggaaggaggcccgtttgatttttggctagcaagtaaacttgcaagtccacccttctttttcttcttgttgcctgccccgccacccttcctctcgtcaaggctctgtaaccgtggtgaggatgttggtgaggtggccgccgaagaggagactgatgttgctgtggacaggcggcccgcaggggatgatggcatagagacagaatgttttggcggtccaaagtcagacgatgaacctggcagttgtgatggcgccttccttttaacgccttgatgaatcgccgctgtctgcttgtgtaaaatggagttttcgggtgatactggtatcgttgcagctgctgcctcgacctgcttcgctgcttgctgctgatgttcctgctccctcttcagcttgcggcgctgagagatgggccttgtcactttgactcttgcggtcaaatagccttccttagttccaggaagttccgtgtctcggtggcaccgctggcacgagtatatgacatggttcaggatctgattcgcgcgcttgttgaccttaaaagcttgatccttattgccgaatgcgttccgccgttgctgctgaagctgctgctgctgccgatcgagctcggtgtagggggtgattcggatgactttcttttctcgctggctcagcgtcggtctcctgtccaggatctctgttgctgcggcctccgcactcgccattggtatactagttgcactcccgttgacagcgctgtctttgtcccgcgcgatgtcgctggattgtgagtcctttttcaactccactttcgcccgtttccttgcctgttttttccgcctgtccttctcaatcctagtttctttcacggggacgaccttgacctttgagttgatgccggggacaaagatggaaccacaggcagcacaggacttggtttgaatatcttcgtggagcctgaggtcgcggtcgttagcgagggagagaaactgcgacatgtaatgtgaggaggcacctggacagtgagcaaggagcatgtgcgacgccttccagaggaactcgaggcgggcattggagtcagccatgtggagtgtagtgtagaagtgcagaggaccgatggactgagcacaaaggtctaactgtaccgcatatgaaggtagccgccacctcaaaaaaaaacatgggactgtctctttttctttttttttttttctattggttcctttgtggagctgacatgtccaacctcttgttcgactacagatcaccaactccccatccatctccaagaatgagcgacattatggttgagaagcagagcttcgccagatacaagaccaacaatactatcgaggaaggcgacctcgttgtcacataccttgtaagccaccgaagctcaaacccactaaaacgccttgtcccagtctacacgcatactaacagtccgcctggtgttactgtctatggatgcaacaagaacagggaaaccatgggcatgattcgggtcaggaagggcgaatacttcaactgcaagtttgggagctataagcacgcggatatgatcgggctggagtacggcacaaagcttggctccaacacagggcgcggctttctttaccttcttcatcccacacccgagctctggaccttggtcttgcctcaccggacacagattctctacattgccgacatctcgttcgtcatgaactttttgaacctcaagcccggtatgtccatgatcgagtcaggaacgggatctggctccttctcacattcgatcgcacggaccttggctcccacaggacatttgtacacgtttgaataccatcaggaacgtgtcaatgcggccaaaaaggagtttgaggagcacggtctatcggatatggtcacgctgcagtgcagggatgtgtgcaaggatggatttgatatggagaacaaggttgatgccagtaagtatacatttcttaggcttgcaagtttcacatgctttacaagctttagcaactttttctgattttttttttttgtgcctctagtttttttggatcttcctgcgccatgggaggctgtgacatctgcaaagaaggccttcaagcataacaagattggaaagatttgcaccttcagtccttgcatcgagcagatctcgaggacggtcacggcgttgaatgagcagggctttgtcgatatccagatgtttgaatgtctgattcgcttcaacgagatcagggtgatccccatgtggaccatcgaggaggccatggagaagcagcgggccgttgagaagaagaggaagcgcgacaagcctcaggcgacaagcaagaagaacgggaagcgtcaggagagacagactcaggaggatgctgaggaggagagcagtaaagataagctcgccaagctagagactctggttgacgatggcaatgactcttcagcagcagctacgcccatgtcgacctcaggatctgaggcggaaccatcctcggccacctccacgcccgtgattgtaccggaggcgaccatgccctccgccaccaccacagcggaagcagagccccgagagaggatcgaccccaagaatgttgtggtgacacgcctaccagcagagcagcgaggacatacttcatatctgatgttcgccacgttcacgcctgccttccagcaaccgagtctacgcgagaagaagacagccgaggctcaagaggctcaatcgtgatttgaattttttgaacccctcctcgcgttcctcggatctgcacgtgattaaagtccttattacgaattgcttcctcgttttttttttggttggaaggtgcatcctcagagaccccttttgaatgcccccaccaccgacgacgactgctggcgatttctcatcttcacaccacgcagtctttagatcagaatcgacacacagcgactccatcagcatcgacatccaggacgacgcgactgcatccacgtccttactgccatccaattaccatcatctctcccatacccacaccatgactggacaacacaagtactcggtgctccttcccacctacaacgaacgcgagaacctgcccgtcattatctggcttctcacaaagaccttccaggaaaagtaatgtctagaccgaatgcctgttttattcactcgcttttcactttgtgagcaaagtcgaggagggcaagagcgcgacttgtgctgcgtgctccatggtacacggacttcaagatggggggaccaacattctaatctttttctctcgacgttcttggtactgatagcaaaatcgactatgagatcattgtcattgacgataacagccctgatggcacgctggagatcgccaagcagcttcaaaagctttatggcgaggacaggattgtaaggtcttgcgtgttgttgcccaggattaagctaggcacccgctctgaatgagtgagctgacctccttcccgatacggtcccttcactattactagctgctgaggccccgcgctggaaagctcggacttggtaaatatggcatcagaactggataaaagtgcccttgagcctgtaggatcctcgagagaacgcgaaaaaaaaaattaatgtatgccctatcgcgcgacctgttggaatctaggcactgcatatgttcatggaattcagcacgccaccggcgactttattttcattctggatgccgatatgtcccatcatgtaagaatagcctcgacagccgtgcccttccggtggcgcaatcgtagtatagggggttgaaactgacgccctccttttgtgcaacgtaatatgtatgacactcccagcccaagttcatgcccgagatgatccagtaagcaccttgctcttgaaaacaccatcagcaccaatgtgaaagccgaagggtgtctaacacaacacccttttgtgaccccgcaactatagactccagcagtcaaagaatctggacgtcgtgacaggaacgcgttatgctggcaatggcggcgtttatggttgggatctgaagcgtaaggttatcaggtaagagagcgagacgcgaggcttgcaggacaacacggacaatggtatgaatttgcctaccatctaacgctggttatttactgcaccgcgtgcactctccctttacctgttgtaccaagtcgtggagccaactttctggcgacagttcttctccgccctggtgtttctgacttgacgggaagcttccgactgtacaagaaggaggttttggccaaactgatctcgtcctgcatttccaagggatatgtctttcagatggagatgatggtccgcgcaaggcagttcaactgcacgatcggcgaggtccccatcacgttcgtggaccgtgtgtttggagacagcaagatgggcgccatggagattgtgagctacgcgcagggacttttgaagttgtttgtggctgtttagcaaaactgaagacgaagcatgcgcgtggcaatcgttagtgaattttgaatcaaaaaagacatactctacaacctattttgtctaaaaagtcaaggactttgttgtttttgctggaagcatcgctgatctgtgtaaagtgtacggacttggaggaaggacgagccttattggcatctgctctctttgcatgtgagtctatgtggtctcaactaaaatatggtagtgatcggcgtgtcccagaagactgggctgtgctgcgtgagagcgcgcgctcgtgagtcgctgttctctcggttcaaggagcagtgaacagcctaagaggaagcacccgacgtatggaggataagcatgttgcatttgacaaacaatccccgcgccgctaggagggcgaggtatgactaaaaagaaagcaaaaaaaggaaaaagtgcctctttacctttgacggaaaaggctgaacagccagcaaaggtggactcgtctgaccttgcatgaggccgtatatagactactgaactcctctcgaggcccgatcaggcttgagcgatgcaatgcaatgcaatgtggaaatatcggctatgctgatgctgcttcgcggtcggacgccttggacgagcccgctgtgacgagggtgcggcgaagaggttttggatcgcggtatcatgtaggacggtattatttttgtcgccccagctcgcacgctagaccatcgcccctgtgtggcattggtacttcttttgcactctccagctgcctgcgtgttttacttctttctttcttcacccgtctcctgcccttcaccttcaaccgcagtcgctgcccaccctcgagtctgcgacctatcctcgactcctcttcgctctcgcctgttcgtcccttgcctcattccgtggcacattcctttgtttgctcattcccagcgaacgttcttcccccattcagtcctcggtcacacgagcaacagataagagcagccctgcggaggaccctgcactcctgcgaccgtacaacgcacacatcacccccacagaccacagaccacagacccacagaccacgcacaagaaaataggagcatcgatgaaggtcgctgttgtcttgactgcagtcctgtcgcttgcctgtgcccagccgcagagcgaaccagcgcgcactaccagggccatcaccctcatcgagaacgacctctatgtttatggaggtaagtaaagcagaaatagcaaataggcactcgtacaactacccctaggctcacgcctattgctttgtctcgaggctgcaactgagagtgaatacattttctacactacatttggttttaggctcgggggcgggaggaacgtgctattcggacctctacacgctgcacctcgacgcctcgaacggatggaccgcgggaacagcaccctggaagactgtatcgtccgatcgttcgacccccctcggttcgacctcttgggctgtagcctcggctgatggcgaaaaggttcttttctacggccagtcgctttgtccgcaacagttaacactggaagcttcgagtccacaccctttcaaggcctcgtctggatccgtcatattcgagcatgatgatggaaaatggtcccagtctgacacagctactgatatttttggcccaagacttgtcaagagcgatgagcccgtccccgtccaggttgttgatcataagaaccgcgttgtgtacacgttcgtatatgacgcgttcaatccccagctcggcactcagctctggaccttctcaacggaccatcttccatccgacattgccaagtcggccaagaatacgaccatggtcacgactcagccgcctgccccgccaccagtaactccacccccgacgaacgggaccaacgtcactctgcctgtacctcctccaccaccaacaccagcacccatcgtcctggctccctttgtggatgtaggtgctgccgtctatctcgacggtacgatagcggtcattggaggcggaaaaatatcgggagacaagatggttggcgacgatgtggaggccgcctctggattctacaaaatggatcggtgctggatctacacgatagcaagcaatcaatggagagttcaaaacctcgtaagtctcatatacgcctttggcccttgaatcgctaccgcgtgcatattcgcaaacgtagagatcctaacactcacgttgacaaaaaatggcgcgaatagacggccgccggtggaaatctgcctttgccgagacgtctcgcagcacttgttgtgggtgagtactgagcaatcgccactgctaacaagactattctcgcaaagtcggcctgctaacatcttcattttcattcattacaatagtcgggagcaagatctatatgcatggagggaacacaacgcaaacagacccaaccgatcagtatgccaaagacttttggattttggacacactgtcgtggcagtggacgcccgggccaagttcacccacgggccgtgcatcgcataccctgattcagcacaataacacattgttgtccctgtctgggttcgatttcgagacgacaaagacaaagtcggccaagaactcgtatataatggtttatgatctggataccactacttggggatcgcagtttggacagatcaaccaatcattctttcagcagcactctattgccatcattggggggtctgtagcaggttttgtcctatttcttcttcttgcctcgatcgcgtctcgcctgtggagaaaacacacccacaagaaaagcggtcttggagaactaaagagaagacatcgatccagcaaggccttcctctcctccgcgactgcaggacctcaagttgcttctgctgtgggcccaaagagtcgcgcctcacgccccagttcagatgtccgatcttccggacaaggattgaacgaccgacatgtcaactacgagccgcagaatggttatgaaacccaggtcgatctttccactctcacgccacgacctgatcaacagcagtacaatccttatgcatcggtccaccaacagcagcaggtcccgttgatgaacgccaacgctttggagcagcaagacgtgactctggaaccctatgtcgatgatgaggaggttcatattaaggatcctagtccccaaggcctccaacagccatctcaccgcagcgacaatacagcacctcggcgctaagtcattctttgtctctactgcgcggatcccaacctcacatttacatcgataccagcatcgcttcgcgggcactcgtgtggacaaggtaccatacaataaagcattatattttccgtcagagcgtttgtataacgtgtgtgatctacttgtcctcaatggcagggtgtcctgcgtgtttgttgtattccacaaagacgcgctctgcgggtctcactccacctaggaaaacagaaacaccgcaaaaaaaaaaagatcgaaaagatgattgttaacagaatgggtcgtaatgggacagctctagtcctctcgtcccagccagcagggaggtgtcatgacagcttaccaggaatatcaacaaagaggtacttgtattcccatttgttgcgttgatccttgaccatctccagatgcgccgtgccctcgttgtgaggtccctcgacgtagaatcgcatcaaaagatgctccttgccctcgccatccagaaccacttgcgaactaaagagggtaggttgttgaaaatgtttcaacagttgttattgtggttgttggtggctggtgttgttgttgttgtaggatgtgtcttgttcgttgaaagatcaaaagtcgggtctacaacattcacggttttttttcttcctttttgcatccctggtacttactgaatacgacggttgcgacgtcttttgctagatgatggctctccatgacccatgatgggcattccaatgatgtccttgagcctctcgttgttccgaactctttccaatgcgtcgccaaagacgtgggtgtcgctgttggatccaaaaagttccgaaacgatggcgtatccgacggctcccaccagaagaactcccgcaccaataattgcataattggtggtggtctttgttgccgtcacgactagccattgagaaaaaaaaaagaaagaaaacgcaagaggtaggtggcgcgaacgtattagtgaacaagttgtggccacatccagaaaaaaaaaaaaaaaaaaaaaaaaaagaaaaaaaaaagccgaggtggtgtggagcgccttgtagtcgtggtagtcctgcgaaaaaagcgcgatcagctcgcggctgtggtgaagagcttctggaggtgtctctgacgttaacgaacctttctccggtgtggagagatccttccattgcttcttatccgtgcggtgtgcaagggcgcccagtggtctctgggtgttgttgccgctgctcttgggctgttccgtggccatgttcctgacggattgtctccaggacgttctgagagcggtcgtctggtgctgagactggtgtgcacactgcatgagggttctcttggaggcgaatgcgcacgaggacgcggtccaggcgcgtagacctgtctggtgaatgaatcccatgacgatgattttgctggtcgtgtgtgaagatgtcgacaatagaaggggagcccgggatcccttgcacaatgagggaagcgcacttctcaaaattgccagtccagccacaccagtgcttgttctacgtcacagagcaagacggtggcgagatctcaaaagattgcaaccctttcttttttctgctcagcttttcactttcttacacggcccattaaccgcatcatgtcatcgaaggcagcaacaccagagctcaaaaagtacgtcgcacgctttgcacgaccaacccggatcaggatgacggcgcggatcgtacaggaagacgttttgtttttggattccccgaacagagcgatcgaggcatacaacagccactgaccgcacaaggatagacaccaagaacaatggcgatggaacctcttattattgtcttgaccactctggaatgcatctctggcggacaacaaaaagcagcccaaggaatacgtgatgggtttggcataacaaaagcggcaccctaacaacatacctccctgctttatctttttccccttatgctcgtctccttttcgttacaggtatatggacaagcgtgtctttgtccagctgaacggtgctagaaaggtcacaggagtcctccgaggattcgatcccttcatgaacttggtgctggacgaggctgttgaggagacaaagccatcagagaagacgccgatcggcatggtggtaaggcaacaagcattctagcagcggttgatgtgttcccgaaacgggtgtctccattcatgcgatgaccgcgggtcaaagaggcgctgatctttcagggttaagagaggaggggactctgcaatcagcttcaatcgactaacactaaaacaaactattgataggttcttcgcggcaacagcgtagtggtcttggaggcactggacaagatctgagtacgtttgaacgacagaacaggagtgggctttttgagacagaatccgtccaattgaattgactgtgcaggctgacagtgttcatctacataaagaaacaaggcgcactggcttttttttatcgagtttgtatgtgtttctcacgtctcaactgtttcattgaaggacatggtaaggagccgatgaaagcgttatttaccaggggagaggcgattgaaagagatatatcgcatcaatgcgttcgcagatattgagcaggagccatgcaccagtcgattgacaatccgacatgcgccatgctgcaggagagtgtgtggactctgttagaaggtttgattgaaactcttcgagcgggcaaagattggaaaatgctcaagaagaagtgaagcccgtgaagggtttgggaaagcgaaggaaaaaaagaagaaagaaaggtgataaagtgagatgcaataactgtgcggcgcccacgaatgatatttggaatggctggaatagatgctccgccgatatggttcttttgttcgcttccatctccaaactcgacgtctggttccttacggccagcaagagcgatggggatggcgtttgcgctttttcctcgccgtgcttggatggggttttttttccttccctacggttcttgccttctgcgtccgacgtcaaatatggtttgagatgcccatttctcgaatatgtatagagaattttttatttttaaaaactgtccattcctctttctctcttctctcacttctttcctcttcctctctccttgcttgcttcatcctctcgcctcttgctccatacactcatctcctaacacctcttcttgacatcacgactgccttcgttttgtttttctcatttcacattgaatcccacaccataacatgagcgcttccattacaagcaccgccgcaaaggctccaaagctgagacgcattgccctcttgggttcccgtgctgtcggtaaaaggcgtcttcatattacgaataaaagacaaccagcccaacctgagctgcactgcaacgactggatcacacgcactgcgggggcgggggccaaaaagaatcggggcgagaagtgcgctttccgcaacttggagcccttgacacacagagagttagccaaggaggtcaggggttttttttgggctgatcggagggatggaattttttttttcactggttcgtgccgttccttatcgccttgaccaccttcacacccagcaacgctctgtgccctcggagctgcagctggcactcctctccaccaccaccacccactccgcgcaatgttttgggctaatatccgtccactcacttctctgcagactatcagcatcgataagcagggctttccatctttggtctcaatacctttcagattctttgcacatggtttatttttggggctgacgatctgatcgacaaaaaaaagcaagacggcgtgagtgttctctcactcttcgagttgaacaagtcttcactcctacctcttttttttctcagtgaggatttgcgaggcccataaaagtgttgaagagaggaagggggtagggaggggagcgcaggccaccgacacgcgattccgatgctcaccgctgttgtccctctatgttatatttcatttcccaaccgaattaccggactggactggaccaccattcagctctcaatgggcacactctactctcttcgctctgtctctgtctcttgctaatgtggcactgtttttttttttactacacttctggttttgtttttccttttattctatttcctctattcatttcttttgtcaccttaggcaaatcgtccatgatcatccagtatgtcgagaacgtctttgtggactcttatttccccaccattgaacgaacctttataaagtcgttgactttccacggacaaccctacgatgtcgagctcatcgacactgctggacaggtagggttcaaaagccgataagactagtttgggtccaaaagaaatgtgaaaaagggtcgccgacatgtcatagtttttttctttttctttttgcatgctctcaattgagttttttttctatattttttctgccgattttacgcgatgtggttttttttttttttttttttggttttccgtattttctaatttttttgcttcaccttcttgccctacacatcttttacctctcttaggatgagttttcaatcttcaacggcaagcatgcgttggatgtacacggatacgtgctcgtgtactcggtgacgagcaaactcagctttgacatgattggcgtcatccgggacaagatcctcaattacacgggcacggattgggtccccatcgtcattgtcggcaacaagaccgatctccagggccagcgacaggtcacaagggaagaaggcgaggaactggctgcgaaatggaaatgtctctcttgcgaaacgtctgccaagacgaatctgaatattggtaagagggtttagcagcgcaagcatgaatgtttttctatttttctttgtcttgctctctttttgaaggcgaggagaacgttgacgctgttgttgttgttgtggatgttgttgaggttgttgaggttgttgttgttgttgaggtttattgttgctgttgtctgtgcctgtgtctgtgcattgttgtttttatgcttgcgcgccggtagccagcgagttatactaatttttttttttttgtaggtcgtgcgttcgagctcatgattgccgaaattgaacagtcgaccgagtcggtgcctgatgaaaagaagggcgagtgcttgattctgtaaaccgatccctccgccccctcctctcttcctcttcctctctccccttctctctcatcctcccccccccccctcctgcctccagcaaagcagaaagaaacataaaatgagatttacaaaaaaaaccagagaacaatttgatgcgcttgagaaatgtcgagttttgttaatgttgtacaatggtttattcagtcgtagggtgtttgaagagttggatcattttagaatacagttgtatgagagatccaagggccagaagtttttttttcaacgagtgttgggtttgaagaactttgaaagaggtgggattgaaggggatgaagactcggtcgaggaggctgctgtggaggaggatgcggtcccagacgaagacgccttcttgcgcttgcctctagaggacgaggccgtcgacgtcactggtgaaccgcgctttgctcccccagatgcggagttgggtcctccatgatagccagcaggctgctgctggtgctgctgctgatgctgctgctgctgctgccgctccaactgctgttgttttctgtcatcctcgaaaagactcagtgcaaagtgataatccgaatgctgttcccattcctcaaccggaacctgctgtcctgggcttggacattgctcacaaagaagcgtcgccttgacctgcatttgttccatctggggtgaaagaggcaaggcatcaccggtcgatgataacgatgtgacacctgtctccgaagcccggtcaacttcaggagaatgtccggctagggtcggttggggagcgggtatgttggaaatcgttcttggctggaaaaatcgtctcctagccttcactccctcctgctcaaacgatgcgttcacgcctccagtttgcgcatccgcttgctgatatgaatgttcattgactaaggccgctgcttctgccacctgatcgaccttttgttccggtacctcgttcctggtctccttgtctgctgccatggatcccggttgaatgcgtttcacgggcgcctttgagaagaacttggtgatgtcgcccatggcgctaccatggccacccgagaaattggacaccgtcaccgtcaagatgaccaggggcaagacgggcggccctcgccctgtctctgcgtctttgatcagcctttcgaccacaccgtacatctttctggccatgccttcagcaccgccatactcaaagcgactcccgaacggcatggagcgcgacattttgcggggtacgcgataagtggaggaccgttcctgttgttgttgttgttgttgttgttgttgtggttgttgatcgcgatgcgactgcataccgccaaagaaccccagggcgatggtcctgggccaccgttccgtttcttcgtactcggccgtgatccgtgagaccaactcgaggcagatggacgtgatccagaactggatctcttcccggtcgttcaaggcggggataaaggatttgtgggagcacatcgatttggacttgaccttccggatcccgatgtggtcgatcccgcgacaccactgccacaactccagtccagcctgatcaccatacctctcctgcagtttccgtagaggcaccggccaaagctgagaggctcgctcgatattatagtccgccatgacctgttttccgaatttaccgcccaaattgcgaatctttctcagctttagtccatgcagcaagtccgggatatacttgggcagaataatagtctgcaagtaacaggaaaaaaagcatgaaaagaaatacagttagatactgcacaaagaagaaaaaaaaaagtgccaaacccatctagtaatcgcgccgctgtttggcggggtatcttacttgctgaaagggcttgttcatgccagatcccagtttggccagcagcttgttgttggccactcccgccgaacacgtgtacccgagctcgtccttgaccgcttgccggactttgttgcaatactctgccgcctttaagatctgcatctcggcccaaaactgttcctcgaatgtgccctcgggaatgccataatacggcagcaattgctcaaactccacacgaaggcgttctgcttcggcctcctgctcccgtttcaactcttcttccgacagctcttcactgataggcgtcccgccagcatccgcacggtcgacatccgaggctggtccagaatccggtaatgcagtcgcggtccgagaagcatggccaccattgggctgatcagccttatccatctggatgtgactgagaggttctgaaaaggacgtctcgtcgaaatcgctctcgagaagctgctccagatccaggtcaaagtcgtcctcttcctccttctcttcttcctcccccaccgcctggtcatcatcgcaaccgacctcgttctcagtctcagttccgttttcgtgttcatgatcactttccgcgtcctgatcgtcctcctcttcctcctcgtcgttattgatcccatccagctgtggcactccatggtcttcatcctcctcgtcatcctcaagacctgctctgctcgacaacgctttgccagtggcccctttaggcatcagtccaaagacaacacctgcttctgggtgatcccgtttccaatccaacatgtgcgccgaatctcgatcccacttgaagagatcctctccgtactcctccatgatccgctggttcacgatatccgtaatgtccatgaacacctcatccagtcctcccttttggtatttggggcagaacttccggaagacgttgaagatcttggcggaagccttgcggtaaggatccagcgagaccttgtgcgtgtatctggagggcgatggataatagtctggtttggagtccccaggccccaaggtggcgacatgtgcacagacaacctctacaggacaaggaggtgaaaggaggaagataaaaaaaaaatgaacacaccttttgttaacatcaggtctttgccccttccccaaccctagcaggtcctcgcttcagaatgcagcaagggtgaggaagaaaaaaaaacgatggttttgttacctggacatatcagcttggcgtcaaacacgttatgctgcagacgcgtgatgccgcgcgctcgtgctgaatagttcaccgcgataatggcattccactgctgcgagacgaggggcacgtccggtgtcaagcctagtctgatttgttctgttcaatacgaacccccctttacgacaaggttagcattcatacccatggcgacgacgaagggacagagaggatcctgcattcagctggtattcaaccgcgtgtccaaaaggcgcgcaaggttaacgtgcctacttgtgcaaagaaacagtctacgtcaaaaaaatggacaggaagggaggtcagtaaatgtccgcgtctgtcatgacaaacgattgcctgtcctttagagaaaacgaaatggacaacagtgtgagggacaaggaaagagtgagagagagagtgagtgagagtgggttacccaggtcaatgtgcaggaagcatttctgccgcttgagcacctctggcacttgggcgcgcggtgcagacgacgccatgggggacaggatgggcggaatggagaagagcaagggacagcagcacgtccagagtgatcttgacaaaaacgaaagcctgttgatcaaatgaggtttggtggctgcgagcgtcaaatcagcacgcggacaaggtttcactggccacacaacgtggctatggcccaacgtaccgctcaggaaccgcggcacaaaaacatcgcctaaacatacacatatctcaatttcaacgaactcatacaccttgcggctttttcgtttcaagtgaactcggagcactttatggaagtaacaaaaagaaaatcgtgtatacaaaaaaaaacatgagataccaagcaactcgatgcaggatacatctacctcacttctcaaggtggcccccgttctactttgccgctccttgatctgtagcctgcgttccatcttctccaccacgaccagtatcctcacccagaacctcgaccccgccaatgacctgggcttgagcaactcgtgcagctttggagccctcatcctgatcagacactagatcactaaacacgccctggtcctgcttgatcgattcgaccacctcgtcctgttttggaatcactgctgcgttgctgcttgttaccgcagactcggctgggtagagtgatatcgtctcgggatattgattgcagtcatagtcccaggttcgcaataccttcgatgcctcacactgggaccgcgtccattgagagccgtacgtcagaggcgcgtgcatgcggaagacgtagatggccgtggatgagatgagaaggagaaggacaagtctgaacttgttgggcatgaaccggcaggccaaatcgaacgtaacgctgaacaagaggatcgcaaagtaaagcgcaggaaggtagtggtgcaagaagagttgacggcccatgaggaagaacggcagatagtggtaacaccagcccataaagaagaagccaccagagagctcataatattcgcgaagccctaaaattgaaaacaaaaaaagttcaacagttcagcaaaaggcgcgtagtcaagatgtaaagcataagcattgtacgccacgcagacgcgtttttttccttctctcaccattgaaatcatcccggtatccacgcttgtcccgaacaaacaacagcagacgcatcgctgcataaaaggcaattgctgctgacgacaagtaccatgtgaaccagtttccgatcaagtaaatgtgcttttgctccttgccccagaagctgattccacgcctcagccaaggccaggatgaaggacgcgagtcataaggatgggactctgtcagtcccgcgttggtagtccacatgactttgtttagctccaagaactttcctaggaaccctagcttcttgtagttgaccatgggtgcatcctctggatctataggcaaatatcattcacaagcgtaaactgtcagtatttttcaagtacaacacaacacatgtgattgaacaacagcgcggttgacttgttgctgttgttttttttgcccttacattggtcgtattgattggactcgataatccatgtcgcttttgcaacgacagcgctcctcatgcaggtcacctcctgctgttcaaaagcccacttgggaagcttgaccttgtgcgagaacagatcacagttcatttgttgatggaccagcttgaacttggatcgcagtgtgtggagcatcttgcccccctcaggatccgacgcttcatggtccacaatctcgacgcgccactcgtcattcgcatctcccgcaaaaccgtcgtaaccgtatccgctgacctcaaaatgattctcgtcctcagtcatgggcggcttcagattgtgtgaatgcaggcgcttgcgggtggcgacatgcaagagacggacataatcaccactcttcagatactctagggtctcgggaatcgaaccgtcgcgtctctgaatgatccagtcgttgttggtatccttgtgagggtacagtgtaatctgttgctctatggatcagaaggtgggcttgagtttttttgcgatcaaacattcactccaaatcatatgcagagttccgtggcacttacgcttgcttccggtttcatagttggaggcgtgcgaatgcaagtaacctccttgtgtgcccacatggcggatagacaccgtggcaccatacgcaacccctaatgagaagaataatgaatacattagtaaggcgcttcctaccaaacgacatattcaagggtgatgtgaggcatggaatggcgtaggaacgtacccaagggtgagtccttcaaggagtgacccaaagtcatctgaaacggcgcgctcatgaatccatcgccctcgccaccggatcccagcaggagaaagtggatctcgaacatgaacatgtaaacagagatgggaaccacgatcaagcagacggctcgggccaagaagtggttcatccacgtgcgtggagatatcctgaggtcgccccagagtgtccacagctgatggatggtcgaagttccgatcgtggcaatgatgaaaagtcccacccacttgacgctgcccgacaatcccagtccaatccctgtcgcaaacagccaaatataccagtcctccgagaacgggtcgtggcgttcgctataaaagttgacccaggcgagggcggtgaaggccgtaaagaagatcaagggcgaatccaaaagaatgagacggctctgtgtaacgatactgttctctgtgggacagcaatataaataggggatcaggattagttttccgcccgaacgatgagagcgcatacgcttcatccactgcagccggggcatgtgcttctcatcctggcacgcttaccaaagagaaccagcagggccgcaagggtcgaggcataaagagaatgccccgagttcctgacagtgtagaacgccattgggacgaccgccacacccatcaggccacacatgaggcgcatggggatataggggactttaggctcgatgtaatccctaatgaacataacatgatgatccttggtcagcccctttgatccttgctgaaggagaattgtccacaacacttctaggcaaacatatcatagaaaggagccacgactcacattccaatctccttaaagtcgaacgaaggatccaggccaaaaatccatcctgtcaaagcaatcagcatctttgccaatgggggatggacgtccatgaaaaaccggcccttgatgtacttggaggcaaatcctccaaagtggacctcatcgaacctattaacagcgggaataaagaaaaaaaaaggggggggggggggggaggaaggaggaaggaggaaggagggtccattagcatcagccaaaacatccctagcgccaacaccatcgcactcgccgccctccagcgcaacgcacgcaagtgatcatccccgacttacacaactgaggtcggatacccaatcgcccagagtcgaacaaccagcgccaggagtgtgatggcgcctacgatctgcaactcccgattctggtaccaggccagactacgcctgttgctgaattttgcatagtgcgtgtggtcgtggtcgtcgccgtcatgcgagagtgtccgcatccgttcacgctccttgtcaaggctgggtcggtggacgccattcgcatgggtgtcatccgacacatccagggaacttgtccgagccggcacggaccctctgtagacgggggtgcccgactgactctggtctaccgcagaactggaggcattcctcatgatgcgaggaggatgcgacgtaatggtcccgagaggatgtcgagcttgtcgaatgaaggtttactctgacgcgagtcctcgagaaaaatgagcctctgttcctgcctgtacgtggcgctgttctcgagaaggcaagaccgatacggtgtagtgagaggaggaagcgcaggagcgagcttgggaaagtggggtgcagaggcagagaggaaagtaacgaatgaatgagagaaagagaaaaatgaaagagggagcagaggggaaatttaaattctattggatgcgatatgattgatgtataggtctcgccagaaagtcatcgactcgatatatttttgcacatttgaacttttgaattgggtattgaatatgtacaccatgagagtacgtgacatgaacaattcaatggtttttcttttttcgcgtcaatcttggcctcgtccctcggccccatctccctcagtaacacctccccaacaggtcctacagcaacatcaaagttgtcgtcgattttttggagcctccgactcataaacaagacgtccccctgctcctcagataaaatgcattgggagcgagatcagtgtcattgtcgtcgtcaacttgagcgtagttcgacatcccaagcgagttggtgataggcgtctttcgcagcagacacccgaaacgttggatcaggcaggacgtgacagccccacccttgatcgactgatcaaaggttgttgtagtagcaagctacttttgcaacaggtaactattggatcaggcaggacgtgacagccccgccctttgatcgactgatcaaaggttgttgtagtagcaagctacttttgcagcaggtaactattggatcaggcaggacgtgacagccccgccctttgatcgactgatcaaaggttgttgtagtagcaagctacttttgcagcaggtaactattggaacgggcggggcgcgacagccccaccctttgatcgactgatcaaaggttgttgtagtagtaagtttcctttacagcaggcattcgttagaacgttaacacgggcagggcgtggcagtcccacgcttcgatcagttgatccaaagtctgttatagtacctatatcgaccggctctttatataatacacttgagtgtatgctggcgcatcccaacctcgtatcctcttcatccgctttacttatcaccctcacccgccatagcatccatccctgagcaaggcaagatgatacgcaaggcaagatgatattgataccattgcacacactcgccaacacacatgtttgacacatccttgggaacaccgctcgacgcagacacatcacccacacatcccacacctcacagacacactcacgcttccctgcacactcactctctgtccctcgtcttgcattatcatccgcatgttggtttgcactgtctgttgttctttctctttcctcatctttcctcaccctctctgaatctgtctcccctcctctctctcttctctctcgtgtctcgctctttccctcccagtctgtctctctctcattctctctcttctctctctctcctcctctgtcttcgttctctgttctctctctctctttccacgtgagtgacatctggctagcaggttggggaccccaccagagcagaggcgcgccttcgcttcggtggtctggccatccgaccgtaggtctcccacccgcgtaagcccccatccaatcaccagttcagtactggaaccccttcacgcccctgacatcggtccgatgcaacgggggctcccagatttactctgggtttacccaggtttagccagtggctcatcactttctggcgagacctataatacatggcctgcacatgcacagtgctctagtctgcctcaagcagttcggcatagcgcgtaggtgccacaccctcactcctctgcatgagaacggacgggagcttcgtcagcagtgtcaaagcgtggccatgtgttctcgggtagtgtcgacaatccacatgcgtctcacgccatgtagccgccatatcgacgtctttctttctactttttattcatcgtctactctactctagcgaatggtttagccattctgaatagtctatcagcgaggaaagaacgttgggctcgttctgcatgatggagctgaagggatctgcattcatgttcagcatggcactcaggggatctgtgagtcccgacatatgagcttgctgctgctgttgctgttgctgttgctgttgccgttgctgtaaaggagagcctgactgtgacatttgaaatgcctcaccagccgcaacaacctcgtgctgttgcggatgtagttgttgcgtctgctcgcctgaatgctgtcgaccaaaaaactgttgttgctgttgttgatgctgtagctgttgctgctgctgttgttgctgttgttgttgctgttgttgctgttgttgctgttgttgctgttgttgctgttgttgctgtgattgttgctgctgtgaatggggatgctgtggatgatgatgctgatgcgttggatatgcctgctgtggtgataggtgatcctggcccggtggagtgtgatggcggttgaaatgaacatgctgcatcggcaaaacttggtgagattggaacagagctgcatgctgttgctgctgacgatgatattgctgttgttgttgctgctgctgttgttgctgctgctgttgctgttgttgttgttgctgttgttgttgttgttgcagttgctgtaactgatgttgcaaatgttgctgctggatcgcaggatccatattcgcgcccaaaatttgactccctccactttggggcacagaccgtggcgatgtggatgtaaatgactgatgcccagacatcccacagctcacaggtacaaggcacggcggtggcgatggcgaaggcgcagaccccaaggactcggtcatgggcgatgccaccgacgcagtggaggtaccaggcggggtcaatggtgccaagtagcaactggaaggtccagaggaagaaccgctggtggcacccatgaccgctgcagctcctgcagagatcgaggaggcggccgagggaggtcccagagacgctacagatgcagtaacgccgccaatggtcgaggtgctgtcggcatttagcacaaggaggtgcctctggttcgaaggcagcatgctggaggatattcgggaagtcgcattgggttttgtccgaagtccaaaccctttatcgcgcaaagcctggcgtattataggaaacatctctttgaacagcgccatcaatggcttaacacgctgctcatccgtaggggtcatgaagggcacattctaattgtaaacaaaaaatgaacaaacaacgtcagatatgtggcgtataaacagccagtagagtttatacactgacaaaacgaggatgccccactatgttcaagtttccttacaggagtctcattggcattggtggtctcgagttctgtgagtggttcatcctctgtagaatggacaagacggccagccttcttgataaggtagtaactcttttgcatattcacacatgccggcgttcgaatcctcggattgtcgctcagggtattctcctgctgataacaaagtgcgagccagagaactgctcctgacatgtggtagaacatcggccgcgttgttggatactgccacagtcgctcgcatgttagcgtgatcttgtttgcgtattgagccaaagtaagcttgggtaatggcgatggagccttggagtgcacatgctgaggatgatgaagcagtagcttgactgagggcaggtgaggtataatagaggtgtcagaagtgctgaaaagctcggcgcataccttttccatacaatcacgaagcgctgtaaatcacaaagagtcgctaaacacttacgagcgaggtagttcatgtcgagcatgctgcccagggtatggcgccaccaccactctccgccagcgtggaaaaactgcgaactgccggtgggtgcatatccagttgtgtcgtctacgccttcctccgttgcctgtccccaatccggaataaaatccgcggggatcgctttgtaccacgcgtcaagatggctgtcgatttccttcattcgcgcctccatccgttgaatgtcgtgatagctcgcctcgtgatcatattctgtgccgtcctctgcctcgtagggatggtagtgcagttgaatgatggatccacagagataagcagactgaatcgaccgctgaaaatataatacaatcttttgatcgttggcatcgcccggacggaattcgcgaggaagagatagtgtctcgcacagcgaaagatgcaaggtctatcaaagcaatggcagcggtgaggacaggaacatgaactaggcacgctggccatccgttattccgtgacaagggcgagcaggacgggacatgcaaaagagctcgtaccacgtattgcgtcaggatcgcagcagtccatttctcggctatccaaatgaaccaccagcaccgacgcgcaatctcgcgctccaatgtaccccacatcttgatcctgctgtccgtgcagccatcgccgtttggatggtccataagatgccagccgcctgcgatcatgatccgaagcgccagtgctgcgcaagcctgacattcccgttgacgtccaacagtggcatcccatgaggaaatcaaaatcaatccttgcacaacagtgagcggatcgcctatgcccccagatcggtcaggggactgcaccaggggcaactccgtgcgaaggtaggcctttgccagggcagcaaagtactcgcctatcgaccaaatcatgtctcgtgtggagcgaacgttgggctctccgttggcaaatgtgggatggaaggggttgggtaagggcaagtcctgttcggcccaaaatcgttccacgtccgcatcgtccatacatcgtgccgaggacgcgcacatggcagcgatgagcattgggtgagggggcgtgcaaaagtcctgcgaagccagctgggccatgaacgtgggcgggtccaagatcggctgcgtgggccagcagtgggtgatgtacagctggatgaggtgagattgtaggaggggcgagagcgcgcgcgactgcaggatttccagctgcggcgggggcggcagctgaggcttttgtgcgtccggaaacacaaaaagccgagagagctttgagctcagactgttgattttttcagacgtctcaatcacagacgagggcaactgcaccttctcggctggcggtggaggccgatgccgcagattcgaactagaaatccctcctccggcagggccaccgatcgctccagcactgccggcggctgaagtggagggtattgggttgcccggcgtgaccgatcgtgatttggcagcatcctgtggaaaatggacgcgacaaggtcccgctgtcgactttttgcgacgacgactggatgcgcccgtcgtggactgatctggggtggtggaggcaggattggtcgatgtgctgtcctgtcctatcgagcgagtcgctgaaactgcagatgtttccatagagtcggacgagtcctggccagcaggatcgcctgccgatggaggtgctgggcaggtgcatttctttggagtcgaggtctgtttccggcgtctggctatcttggatttctgccaaggaaacgtggacgcatcctgcagcggtcctgctgtcgggtctttgagcagctcgataggcgggatctcgagcgcctctggctttgcgcctgtggtgttgaggaactcttgccagggctcctgaggcactggtgtgggggccttgacgagctcgacataggtgcattccagatccaggcgggtacaccgcgcacagcagggttgaccgtcgcatttggagcgctgcttgcgacatggcagacaggcgtctctgatcttgaggacggatgtgggcggaagggctatgccaagggtgggcggtgcaggatccgacattgggcttcaaggtggatcgggagcaatggcgcaaaggcgtcgaatgtccgttgaggcgagcacggatgtagcggcgggcaagacgggggagtgggacgaggggtgagagtgggaccgaggagagcggaggaagtgggagtggagtagagtggagagagagagcaggaatgggacagggaggcaggaggagtaggggcggggtgtggatggatgaatggggagcggggggatgctgcaggcttgtgaaaggagacgacggtggtgagcgtgagcgagcagaaggggaggcagtgtcgtgtatgtgtgtgtgtgtatgagcgtgtgtgtatgagtgtgtatgagtgtgtatgaatgtgtatatgtgtgtgtatgtgtgagagtgtggatatgatagagggtgagcgagtgagagtgagagtgagaatgagagagagagagagaaagagaaaacgacaaggaggtaacaaaaggtgagaagacagaggacgatgtccagagcaaagaagacgacgagagaagacagcaaaaaaaaaaaagataagacagcgaaaaaggaaagaaaagaaaaaaaaatgcaagaggggaacacgggctagagtgcgttgcttagagtgcgtgcttggagtgcgtctgcttggagtgaacgaccgaacgatagccgggaccacgctacagacctgcatcggacgcatactgcaacacactttcagcgcaagggcgacgctgcactgtgccgcgccgcattcactgccgcctgcagccgggcgagacatgcaaggcaacaggccacacacacacacacacacacagagacacgcatagactccacgccaccaccctgctgtagatgcagatgcatgaggggcacacgcgccctggacgcagcgcacgctcttaaccctgactccctttactctaaacacgaaccagcgctctttcctcaacatgccacgtctgcatgttcggtcagcatgttgtcaggtcttttctttctctctctctcgttctctcgctccttcgctctgtctgtatggctgtcatcgtcttcactggcatcttcattggcatcttcagaaagacagcccactcccgccgctgtggaaggaagtcaaactgacggaccattcaacggacaaagaaatgtctcgagccttttttttttgatggacaaacaaggaaagcaattgcggtgcaactttttattttatgagagcaacccacaccacccacccaaagaatcgaacgtcaaacagccgaataaagcatatcaaaaaaaaaagtacaagcgaatttggaacgcgcgtttcatcgtcgcaaactatcgagatcgaaaaaaatcacctggtgctgacccccgatctctcgtttttggatgctgatatcgaggctcttccggaccccacctcccatccctttttacttttaacagacgctccagtgaaccgtgcgacgatcggtgctcatgccttccttaccaagccatgatgagcacttcatgaaaaaaaaaagccaggggggggggatctcaaatcggtacgcgtaaatggattagacgtagaaaacgacactagcactgcacacccaatcgaagacaagagtacagtgggcgcaaaaaacgacacacctaaaaactgcgagaggagacaaaggtacagagatgagtatgcggctacatgctttacataccctaaacgtatacttttttgcatatgtgtagaccaagttttgaaaacgaccacttctgtcagataacagcggcgttgcaagcacacatgctgaggcactgacaaaacttccccatcccctccccacttcccccctgtgtcgcctttttgttgttgttttgcatcgttcgaggcgctcaagttcatcagaaagtgaggtataacagaaaagcgtacccctgtagatcggaacgtatggcccgagactctattgcattcgtccagaccttgtcaaacccaattttttttttacgatcagtccaaggagagagggcaacgtcagctaactcttgtgtagttcagatcctattgagagccctgcgcaaaaagacgttcaccggttatctctccgatcacactctctcgctctctctcctcctttctctcactcttaaaagtctactgacctcaagcacaaaaaagaaataagctggctatagactgtatacaatacccagaagacacgcagcaattaggttctacaaagagaggggtctcgaaccctccagaacctcattatcgcgcagaaacaaggtctctaccgggaccaacctttctttcgctcaaggttaaccacaatagcaactataaagacaaacagtgcaaatccaaacagtgcaaatcccgaaaggaatcccgagatgcaacttgctcctctcggaagtgcgcgcacttgcaggaggactgcgctgcgcagaaaaagtaaaaaagtaggaaaaaaaaaagaaaaagcgaagcagcgacgaaaaggctaaaaggtaaacacgatagtcggtctgagactggtgcaaagtgaagtctgcatagttttttaaaattacaaggatctcaagttcataatctgcttgcgatggcacagggtcggcccctaacagtaccgcgtcattccgccgatcggtcccactgaggcctaaaacgcaaggacgtcacctagatatcattatcagacgcgttagaggatagactcgtgccacgcgaagacgatcgataagtcggtggaaataaaaagaccgttaccctgctttgtttcttgcttaaaatcctcctgaatgccctccacgaacctcctgaacacctcgacgtgctcccgaagcgatgtcttttgccagtctattggatgatagcggacaccaaggttagctcaaagtgtgggttcctatttaatccaagtatgaggggacgcttccttggccattgtcgtacctttgagcttggatccttccttatgcgtggcatcatactcgttcagctccctgacgagttgcgggacagttggtggagaacttgggtcaaaggattcgcatgtttctattgggatgggtacacacacacgtcctagcacgagcagcaagacgatcaacatcagcgatcactgcatggacagttgagatatgccccttgtgcgaccataacctagcgctcttacctgtcttgggatggacacagaacggactcttcaacaaatgcttcatgtccgttgtgactttgtcgtccagacgaggatacgtcaactggaacttgatatcccggataatgagttctagatgttgatgcttcttcggtgactatttcagcgaggttgacggggagattagtgttcagggctcgatccaccagaccaaccatccaatgtatacagccgcacttgcactcacagctgcctttgcgtctctaaagatagccactagatcatcccatttctgttcagacgcacgccccggtgtttcttcccaagcggcccgcacttgagcttgcacctcctcgtctgggatgatggcgaggaccttctcccagtcctcgggctttgccaaaatgtcctgagatccaagcagaaggttcctgaaatgctcattaacagtttcgtatgaccggctatatttgaaagagacaagcagggcatcaggcgacgttcaaaagccgaagctgtggcctatacaacatcatccaaaaaaaacgcgcttgaaaatacctcaaggagggatgcatgacgtttggcagcttgaccttctttccctgttgcgcacctccctatccgcgagtggtgagtagagaatgcacatgtttagcttctatccatggatcggcaccctagagcagctcggagctagatcacagtaacaacaaccactttgttcttaccttcaccacttcaagatacgacacaatcgatttccgctgctcgttcgtaagcaggcgggccctctcgtccgcaatccagcaatgaatacctcgacgcccagagtacacccagagcaggtgcttgaatccaaaatcatccactagcgccgcgttgatgatcttcatagccactgtcatgaactcccagcactttgggcacacctcgcctccggagcagcatgttctgatctcgtcgtaatccgtcatatcgatatcaaacaccaactccttgctgacaggttgaaatgacgacgccttgatcatgttcttatccttcggtttgatgttgtaaatggcgccgagatcgattttggctggacagagtctgatcagctcctgcttgaactcctccacgtttcggtaggactgaaaacggatgtacgtctcgtcgatcagagtgaagcaaaactctcggttcataaacgtcttggacggcaccggcgctagagagtcgaccccgaggtattagcatcacatgtcgatgagctcttttctcctgttccaagcaaagaagtaatggtcgtagcatccttactcttgttatagttgagccagtcgtagtatggtttcatggggaagaagtggcggtagaagagcatgagttgcctcggcatatcgccaacaagatcgtctgcgtttgtgttcctgttcagtagacaaagaccgggtgttaggtcagcatacttcctcgctttgtgtcttccttcagcgcaccgccgcgctttctgacaacgacagctcaggggggcacttactggtaaatcaaggctttagcaggggcaggcattctgaacgggttgtttttgacttgtgctggtgctgcgttggtctcgctttccatccatgcagagtctggaatgtcgccaaattcatctccgtccagcattccttcagactgccctgcctcgactgtgggttcgccatgcggccctccgtctagtcacgccgaatgaaaaggttagtggaggtacgaaaccatgccttgagaatctccttgccactgcaaactggacacgcacttggcttgggatcaatatccatttccgacatgattatggtatgctggcgtaacgcgctgttgtgaaaagatggaacgttggaaaagcaaagatgccgaggtgcgtttttgcctccaataaaaaaaatcaaaacacacacgcctcggacgcgcgcccgatcatgtgatttaattaaagaaaaaaaaacgcgtcgctcaaaaaagcactttacaaaaggctcaaaatttggcttccctcccacgaaccgcccgctgcgagggcaatgaactcggcgacctggccagcctccacgcagatcatgcgatggtactcctcgtccccaaagtcagccataccagcggccttttcggtccaggggttccagaccacgatatcgctcagtccattcttggtcaattgaatgcctccctgctcggagccgtaggggatttgaatgtggctggatttgaccttggcatagacactgtcgacctctccacggatcactacatcaccctcctgatcagccgatttttgcagaaccttgtccacgtagttcacgccactcagtccaatgaccttgaccttggacgcatcctagtcatgagaaacacgatcgattctgtgttagacacaacatccctgcgcgcgactcaatcctcaagtgctactgtgatagacccagttctgtcagtgggaccaacttacaggaatcaagaagtacgtgtgcaaaagagtgttgaaatcgaacgccttgtctccaatgttctgcacgcgcaactgggtctccagagtgcctgcagatagcttcacggtgtacaccagctcaaagtcaaacggccacatctggcggtgctcctcagagatcatgctatgatccaaacctagtgcgtgcaacatcagaatcttgaatatatacactttgccaacaagggtcgtgtgaacaagcacgtcggtacccgtccacttaccaaactgcgcagtaacagtgtcctgatcctctgaagagttgacgagcttccaacgcgtaatccgagcaaagcctgtgcagcagaacatccagactggtgagaatcaagagtgctcgtcccgcgacatattaagccctgttcgttcaaacaacactttcgttgttaccgtgctgagggagactggcagtgacatggggcgcctttcctttgccgaaaactgggaaaacgagtgggattctacgagacgtgcaaaacgaacgcgagtaatggcgaaagagactagtaagaagcggggaggagagacgcgaaggctcaagccagactcagagaccaaattgcaagcctaccctccgcggatcgcctttgagccatcgactatagccttctcactagtgacgtgaagaaaagagacgaacgcgattaagtacgcgtgtggatgaaaggccgagaggcgttttgatggacgcgatgcggacggcgacgactggctgacctgagaaagatgcgctctcggccgttgaccttccatgaggtgagggttgcgccaaagagatggatttcggtggatgagcccgagggatgcgtgagcacggtcttgctgctttgttgagagacgggcatggctgagggtctgggcgtgtctgtgtcgcgagagagtaagaaggagtgagagcgagatggatgaggatgtaggcagcgagtgagtgagtgtgtaagtgtgagtgtgtatgcgtgcgtgcgtgcgagcgtgtgtgtgtgtgaaaagaaaagaacaaaaaaatgaagacaggaagagaaggcaggaagacaacgaagacagggatgcgctggccaatgatgccagtccgataaggggctgagctgcgagtgcggtcatggccttgctgggaatgaaccttgagggggacgaaaaggagcgcgaacatggtcacccgcgcggggtgggggcagggaacagcaggaggaagaggaggagggggacgggcaggagaggcaggagcagaggagggacacacaacgaggggaacagctcagagggggacaccagcacgatcaagggccgttggagaattcttttttcttctcgttctcactcttctctctctctctctctctctcctctcctttcttgcctccacactcccctctctctcgctctctctctggatcagctcccatcccatccttccatcatgcacaagcccacattgcccttgctgctgctgctgctcgcctgcttcgctttcctctcattcgtctcggcccagtgcgggccaggcgcaggatcatgctccgacggaaactgctgctcccgagctgtacgttcttcattctgattcactttgcgttgttttttcaccacactccgcatccacttttgccggcttcaagacctttttctttctttcttctggtttctcaccactcgactatggatcgtctctcaaacacatagggcttttgcggcagcacggaactccactgtggcgccggatgccaagtcggctttggtgcttgtgcaggcggtggatcaagctcgtcggccgtcgatccctcggtcacaacagccccctatacccctcctgccagtacctcgtcagaaactgtatcgccaacggtcagcagcgtcatgccatcggttgtcaccaccatcaccacaaccaccagctccaccacatcctccaccgcatcgagctcatcctccaccaagggcacgttccagctgcaacccaccggaagtcctagtggagccacaccctcgcaggacaatggagtccgctcgaccgttgcactggtcgtcgtcttcattgcaggcatgatgatggtgtagacttcccccacgccccagttcttatatacctatctccttacctgtagacactctactctaatataattatatcgtctttcaaaatgaccacggtatgatcgaatgaaaatttcttatccctatcagactgacaaaaaaaaagccacgatagcaaagcgcggtggtgatcgacgttttgaaccttcagctcgacagctctttctctcttttgacttttctctctcccttcctcaactctacccacctccccaacaagataagaagaaaatgtcgctcacctcgcatcagatggaagaagccgccaagttactccctgaacttctcgctcaagaacaggagctccagttccctcgattcaccaacgatgatgctctcgagctcggcaacacgctggtcctcatggccaagaaccgctccccgttcaagggtgtctccgtcatgatcacacgcaacggacaacagctctttcaacactctatggaaggcacgtatcattgatacacacaacacacacacaccatccaccagactcttttgctcttgctagaacactgttccccctcagttgttttgacctttttcgtgtgtttcgtactttcgatcttccccccccccctggtccttcctcacctttgaaacttgaacggactcttttttttttttttttttacaggcacaacggtcgacaatgagaactggatgcgtcgcaaggtcaacaccgtcgtccgtctacagcactcctcctactacattggccgtctgctcgcctccaagggacaaacagacatggaaaaatcctacatggttccaacggccgactatgcctgtcacggtggcgccttccctcttctgatcaagcatgtgggctgtgtcggggccattgtcgtcagcggcttgaagcaggacgaggaccacgccatggtcgtccaggccatccgccagatgatcgctatcatgaagagctaaagcgacgaaactgatataaaaaaaaacatatatagaacgtgcagatgtcaatttgaaacaattttttttttctatttgttttctggttgaaagctgtgcggttttctattaatacaaaggttggagcgttgaaggggagaaggggaggaggaggcggtggtggtggggggggggaataacgattacaaaacatctcgccaaagctgctgtagtaggcacgaaacgaaaaaagaaaaaaacaaaaacaattatgtactgggaaaaaggaatacttatgcgatggtgcgagcaagacatgtcagagcctgagcagcgtcctcatcagcctcttgcgcagtcgcgtctaccccactggatttggctccattctctgacccaaagtcgtggaccaccaccaccatccctccgctgtctccttgagattcccgtgatccgctgtgggtgctgctgttgctgctgttagcctgcgctggtccacattccacctgcttggatcgtttcgagttttcgtcatcgtcgtcctcacccccatcataactggcaagctgggtccgctttttcggattagggctcgtggggaaggcggtgagcgaggtcgtcggagaggtcgggctgggtcctcgcccatcgtgatccatcgccgagccactctctgcagaggtcgccttcgagccatcagcggctctcttcttgctcgcactcggaccggccttggccagacctcgacccgatgcactagacgtgctgcgtttcctctgcacgttccaaggctcttcctgtataaagattggctctggctgcaatgatttgtgtcgggcatggctgacctgagagggcttctgctgcttctgttcagatggaggctgctgcggtggctgcggtggctggtactgctgtggaggagcagagggcgagtgattggggtccattggctgaccagtataaggagggtacgcatagccatacgatggaggatagttgtacggatgcgcaaatggcgatccatgcggcggatacatctgtggcgagggcacgccgctaaagttccagtgcggatggggtgaacctcccggcgacgctgatgacaggggacccattgagggcgatcgaggctgcagaggcgagagcatgaagggtgagatgggcggctgatctgcagagtgaggcgacagagtgaggctgctcctgttgctcccggtaccagtactctgtactcctccccctgatgctgctgttgctgctgctccttgatgatacgacgggtgcaagtgatggggctctgggatggtcaatggtggcaggctggatgcaccccggtgagtccgtcctggaacctgacccatcgcagccaatgacctgtcgtcattcgtggctggctggcccatctggcctgagggcgaccgcagttgcagcttcgcaagcgaagatatgggcggcagcgagggcgagggcgagggcgattcaccaatgaacggggaaagctgtcgctgagtcctgttaaagcttccttcgacaggggtctctcctggaggaaacagaccgttgtgttgcgggcccggtgagatgggcgatggcgggaaattaggtgagctggggtaggcgctcctggggctggcaagatcgccgacggatgacgcaaaagagtttgaccgcggacgcgactcgagactgaaagaattcggtgctcctgacactccatggcttggatcacgctctgtggagggactgggggcgtctgtgacgataactggcggcggtgccattttccttgcggtggtggtaggaggtgatgtagctggcgatggagagcgcgatgtggacgaagacgatggcatggacgactctctgtctggatcttccttcacagagctctcgtcatcgatatccatagacattacactgtttgcagaagctttcatcacagcggccgacgtgctatcactcaaggcgggaggatcctggcccgtgatggagcgaatggacagcgcaagagcctcgttcgactcattaaggaacttgatgtggctcactgctccccgaagcacgttgacgcggtggcactttgaggtggcttcctcgagatgcttcggaggaagaagcttcgtgagatcgtcaatcaactacgggttttaatagtagagtcagacaggggtcctttgcttcagtatctctaaagtaaagagtcatctcctgctcacacacagactcggctaagagaaacagccttttgcatacctggttaatacaatctcggcgcttcctttctacacgattatgtgtctcgcgcctgcgctgcagcttgtcgagggcagtcttggtatcaagcggcttgcggttgaggatgttgacccctgccagatcaaaggactttgtcgtcttgaaggactcggacgatatgctgccttcgaagcgaaacaccttaggggtcttgggcgtagtcgaggtcgttgcaggcgactttacggcctcggatgctgacgatgaggagcccttgatggcttttgcctttggagcagcttttgcttttggggctttggcgctcggcttggctgctgttgccacagatggggtctctattgcctcgtgcgctgtgctgccgctgttgcttttcccgttgctgttgtccgggtcgtgtgcgttgggatggcctggctgaggagctgatccgtgtcctcccacatatgcatgcggcgggccgtgcgcatatggaggagggtatggcatagacccatgaggcggatacgggtagtatgggtgctggtggtggccaggatgctgggtgtggccatagaatgttgaagggtgggggtgggcaaaggcatgctccgcaccgctataggcgaccgtgccagggtgtggcgagtgcgactgtggctgcgacgaggatgtgttggaagagggctggtcgtgcgctggccatggtggggcctggttcgaggccatggccgttgtgggagggcgggtgccagtggaggaagggatggggaagggatggggaagggatggggaagggatgggatgggctgaggaagaatgagctgacaatactagacaaggaggcaacgaggcagatggacaagagactggcaggaatgggacgataggaatggaccgacagcgcctggcaatgaagaagcggcaggagtggacttaagacgaggcgatgagtggatgtgtggacagggggagagagagaagcaaggaggagggcaggatagagggcgaggatgaggatggacagagtggacaggaaagcgaaagggctggagagagagagagagagagagagagagagtgagagtgagagagagagtgaaaggtgaaagagcgagcgaggcgaggatcgaatcaaatcctcggtaaaagaaaaaaatctgcctctgtctgcctctgtcggcctctgtcgtgcatcgatataccgggttacagacaggtctgctggtccaactgccactgctgcacaacgcgctaacacacgcaaacacaagccgccatcccgtcagagcgtgcccatctaccccttcctcccttccttccttccttccttccttattccttcctgccctctcctccttcctcatccccagtcccatcgcctcatcgccgactcccagatccagatgccacgcaggtaggggtgacctggaggtgatgtaaaaaaaaaaaaaaatgataaagcatctcatccctgtcaagcacgccaggaaagagagtaacggggctaatcctgagatatcatgtctagaatgtcagaaccactttgacgctcagatggcctcccctctctctctcaatgtcgcattgcttactgtgtttctagccctatcgcgttcaaacacacctatgctatgtatcagaaatgagcaagctgggctcaagcggttgcccacttggattcgttattccagaaaagggctaggcgtacccttgcccctgtaccagaggtggttggacaatttgtgttgtgttgttgttatttatatctgccgcaggtgttgaaaaatggaacattcagaaagaacactttggtctccgttcccttttttttcgccctttttttcttgtgcttattaccttattccgtcaactgtccacgtttttcctgacactctacttcaggtgctgcagaacgctttttttttttttttttttttttttcaaactgaggatgtgcttgaccagacaagagcacgctaaaaaaaaaaatggacgtggtgcgtctgcatgctatcaaagaaaaaagaatgctcaaagagtgtaaccaaggtctgattccaacgctgcctcgcacatgagggctggatgacactacacagactagatcgcaaacacaaagcaaagggcagcagcagcagctatgtattggaaaggagacccggcagagtcaaaaacccgagaacggccatggaattccaggaaagattttgtcgtccattttgagccctgatccagtgcaccctattctcctttttcaatcaaactgggcacaagcgtctgtttcaatcagataaagcaagttttgctctgccggctcaccgcactgaacccacctacctcctccctttgggtccacgactcaaaaaaaaaggagaaatgtgtatatcctgccactgactgctgcaatgtcatacaaagacaatgctcactcttaaccaagccctgaagtgatgaatccatcgccttcttcactgcttccttgtcccctccgggtcaaaagagcaacatctgggttgcgccaccaaaaaattggatttttcttcaaaagtgaaaaagttatcgcgtcaacagcaggatttgaacctgcgcgggagatcccatatgatttcgagtcatacgccttaaccgctcggccatgttgacttcgaccaatcagattaatgatcgaatgaacgtagaatttctcgaagctatatatatctatggcacatcttctacgtacacagtcaattacaaagggttcgctatttgaacgttcatttatcaagggttcgctatttgaacgttcatttatcaagggttcgctatttgaacatgcaattacagggggctggagatctgaacatgcaattcacgtgaaccctttgtaattgacctcaaccatagaaaaaaaaggtttcgctaatcacgcccacgcgttcattcaccagcatcccagcatccctgcatccctgcactcattacacttttaaacgttggtcttgacgtctagactgttctttcgtcttttcccgctttgagagttgaagagtctagctagcttatgggacgaggttgatggtttgatgttggaagtgaataatgactcgttcaggaatgatagatttgctatgaagaaaatgcttatgatatgaaaaatctcggaacaacttttaatctgagggatcattttctaccatagctcaagctcgggggctttattcaaaaaagctacagaatcttgctggctacagcgctactgaaaaagaaaataaaaggttgcagacaacgagaaatgcgattttttttgaatgtgggatggaaagcgaccagagcattttttttagtggatagtgatcttcttgggcttggccgcctcacccttagggagggtgatgttcagcacaccgtcttggtaggtggcactgatcttgtcgcggtcgacagactcagggagcgggatggagcgcatgaaggtgccgcaacggcgctcttgatatcgcacattgtcgcggttgtagtctttctcgtacttggtctcggccgagaagacgagcgacgagtcagtggcgtcgaccttgatgtcttctttgcggacgccgggcatctctgcgcaaattttccaggatttctcgtcttcaaccacgtccacactagggttgatgacgtccgtaggggtggaaccttcaccagtggagcgcctgacccggcgggtggtcgcccaaggatcgttgaggtggtcaaagacttggttcaagcggcgctcgaggcggtcgaacggttcggtgccggcccagttgataagagacatgttgtgatgtggttattgtgaaggaaagagagtgtgtgttgtgtgcttgtttgagttgttctgctgttaagtaaagatgtaagtggaagagtgaggagcaaaagcaaggcgttcgcgagacctttttatacgcttttcagctgcatgaacgttctacgtttttccacaagctagcacaaagcgggtgcggttggcaccgtttcggtcacacgtcgtgaacatcaaccaccagcccaaaacatcagcgctactgtggaagttgctggaaagggctatcgctcagcactcggaattacatgtaatgtttgggtcatgtaaggggagccaatccgacgcggtaaactattgtcaatcttgtgtaatccctctcactcatcccaaacacaccgctgacttcattgcgacactatgcctcgacacgacgactacgaggctggcaagctggtcgacagcaacttccgggaccagcagcattctacggcccactttgtccgtcccgggtcgcatgaagagcggagcaacagccgcagtcatccagcgcagggaaacgactggcgtcgtggccatggcacccataacaacaacagcacccgccacagtcctgtcacgcaatcccaccatcaacaagaacggctacagcagcagcagcaacaacagcaccactaccagcagcagcaggatggtcgctcagccagctctgacaacaggctcggtagaaagtttggtcatgctcaacacggaacccattcgcccgagaggagagcatcttcaccgagaaaaccagctcacgacgattacgatcaccacagaaccaaacgggtacggcaaaaaagcatcgagtgtctcccctttcttgttttcactgtgtccttcctccctttaacgaccgtcctttattgatttggctttgatgcacatagatacgcagccccgacaaccacagcaacaacagcagcatcggcgataacgactttcaccagccaaatcgcctttctcaccagcgccgtgctcctccgttgcaagagggcatgaggtcgaatagcacgatacccactggccctgggtcccatcagcggagagggttcacacctcaagacaggatgatgtctcccgggccttcatcgcatcaacgaaaaccccttccaccacaaggccaggttatgcagaaagcaggcgttccctcgcggaaaaactcttttgaccaagagcacgaatcacagcaccgccgtggacaggacaacagcaacgacggaagcaaccaaaacagcctccggaattacaatgatggttatgcgtacgaatctccaccaagcaagaaaacctcagaccagagctatgagccgtggaggaacaatggagcaggccagaatcatcgtgagcggagcagtagtttcaacgacaattccagtagtaactacagccgaggggcgaacgctcacagtctgaaaagcaaccctggaggaccagcgcagcgagcgaatgaccgtaaccgaaccaacaaccgtcgcagccgcagcagaagcagcagtacaagtgatcagactagagcggctccttatcgtcgcgataacctttcgcctcgtcatcgacgtaccgacagctcgcattctcccactccagacagaagatcacctagagatgatttcaaagctcgccaccactctccggatcgcggacgatatggacacaatcatggacatgacagggtacggagccaagattcacattacggtgagcgacgaccgaaaatgtcgagccctactccagccgacactcgtcataccccgcagtggacgccgcacgtcccagccgcccttaccaatgtacagccacctcaggtgagatttctcatacatcaaaggagatgcgtgcggggcgtacatgatgcctaaccctctaactgtaacctgtttgctcatgtaggtttatggcatggacgaagcatatcttcagcagacaccttaccacactgctgcagcacctatcccctatgccgcattgttggcaaattcaccagcgtttgtgcaaggactggctcagctatcggcacttttggctccacagcagacaccgccaattgacagtctgtacagcatcgcttctgcgttggtttctggggcggctctatcaaccgcggcgacagttttggggccacctctggtgtcaacggaaacaggaggagtaccagtaggaggagttctagcggcaggtacatcgactcctggcacgtttgaaaatcctctgtacgcaatggcttcactaccagaacaagccagccaacccattgattgtgcgagcgtcgcaacatccataccgcccactcaacgcacgacaacgccactgcaggttgacgacggcgcaccggacgcgctgttggcccgtctgtctgaccctgtcacggcgcgcctgttgcaatccatttcacccttcttgtcgcagatcccttccacaaacatggctccatcgccaccaacagcgtcaattgcatctgcaacaccggtcgcttcacaacccatatcatcatacccggagtcgcacagactcgagagtgagtctagtgcatcccgcaaagacactgcattgggttcgaccttgcctaccagtgacgcctcggtctcggcgccttcctttgagagcagcgataatggagtgagtcccagcaaggagtcgatcaagatcacggagctgcctgaatgtaagccttcaagcgccaatgacggggtacagttggatgtaaagtctgagaacgacatgtctgttgtggtggccgccagtccgacgcttgctgtcaaagacattccagaggaggcagcagccagcagcacgtctgatagccacgaaggcgtcctcatacataaggacgagccagctgaaacggactttgtcgctatcaaagccgagaaggagagtgaaccccgaatcgcttcagtcgaggctattgatgcaagcatggatgtcgccgaggaccacgagcgctcagaggtggcgactgaggaggcgctgatgaagagagagccctctatagaaccgcactgtgcatcgcttgaggattcggtatccagttccacagaaacaggactgcctagccaacaaacaggtggagaaccaaaggatcccaacagtacagtcaaggctgaaacgatggagtgtggcacctccctagcggatgaacccggtccaaagatgacgcagccagtcatcgagtcgtcggggacattgacggtcgagtcggagctaccctccccagcagagtcaatgtctactttaagccgtaccgtggagtgtgctctggaacaaagtagtgccgcacaggaactggatcatttcaaagagccgatctcggtcaacagcgctatcgagagcacagaaacgatggatttgggaatggagctcgatcacgcgatggacgacatgaccacagaagcaagaagcccagagaaaccaaaggcagaaaggttgagtgactctgaacctggagatggcccgacgtcaattgacatggaactggtggaagagtttccaactgtgcctgatgtggagaatgcgtctcccggtcccacctccctctcccgcgcggatggctctcctgcccaggacgatggtagccatcaagagaaccagcctcatctctcgtcatcgccaccacggacttttgaacgtgctcactctgcagcccagaagggcatccgcgtctacaccagctggcatcacgtacccggtgcagacatggctttgctgtcggagatgagggcttcgtcggctgatctgggacggttccggagggaaacgcgatggttggaagagcgtgttagtcgaccgcggcgcgacgcggtgtctgaggacatgtttgataaggcgttgggactgacccgaatgattccattgccgaggcggaagcgggaccatccttttgagtctcagcaaccgaagcaaaagcaggatcaggatcaggatcaagttcaggctcaggatcaggatcgctctcaacttcggtctcgcgagcaggctgaacgagaggaacagcacatgacgaggtcgtttggagcagctgttcgactgagtgcagattctaggctggcttactcgaccttcaagacccagctgatggaggagatggaggagcagttgaggttggagagtgaacaaagtgcgttgcagcgggcggtggagaggaccgagaacaagattaaactgaagcagcgacttggagagcaagcggggcagaagatgagagaggtgttggagaagcaagcagagttggacagggaactggaaagcgtccggaaagaggagcaagagtatctggagcggagagagcagcagcgccggacggctgaagaagagattcgacagcttgaggaaacactcaggacacttcaggagcagcatcagcatcatcgccttcaacatcagccattacaacagcagggcacaggcactgccgccaagtgaagcagctgcagcagctgcatgaggaggaggtctgtaggtgtttacaactctgcgggaggacaaaaatcaaagcgatggaccgtcatgacgatgaggcgaaatgatatgctcatttcttggtgctttttattactgtacgctgcgtgccgcatggtgcttgagtttcctattactttttctttcttttttttttttttttttttgatcggtgtgttgttgtcgattgtcgtcctattattgtatgcttaactgtgataagcatccgcaggggccacatattgcgggttcgctggcctattcgccggtactgaggtcgggacaggttcgatgaattggggtccgtggacggacacgatcggttttgagatcgtggaggcggcggtggcgggcgagggttcaaagacggttgcgctctggccaacggaccctgacatgacggtggtggtgggcgaggggaaggcggagtaggaatgcgattggccgggcataggcatggggctcagcgaggccgcagcagggggcgaatggtagtctgggctgctgtgctgtgcataggcgacgctggcgatgccttcgcccggggcattcgcggcattcgcggcattcgcggcagacgcaggctggtgggggacttgttgctgttgttgctgctgctgctgttgatagtaggggtcggtggggaaagtaggggaaggaactggctgcgacacgggtggaggtgccgcaacctttgggtagtagctttgatgttgctgttgctgctgctgttgctgctgctggaggttggggtccacataagctgcggctgtgtagtatcctgagacaggtggctgttgctgctggagagggacagactgagcaaactgctgatgttgctgctgctgctgctgttgctgttgatattgctgttgctgctgctgttgcagctggtaatcgtactgctgttgctggtactggggttggtattgctgctgctgctgctgctgctgctgttgctggggttgggcttgctgctgttgaggaggcgcttgtgcaaactggttctgctgatgaacttgctgcatgggcggtagaggcccgggtggtgagaggtcggccttgcccttcttggactttttcttgttgcggaagaagaagaacagggccacggcgacgatcacaacggcgactcctgctccgatgcctgcatacatggctgtgttgctgctgctgccgttgtcgccgctgccacctccggtgctgcctccagatccagtggtgggccgagagctgccagagccgctgctggtcgggatggggatggaggggttgtacgggttgactgttggtgtgtccggcaaccaaagagtcaaaggtccagacccgcgcggaagcgaagagcggatgcacaacgtgcgagcgagggcgaggggtgataccaaaaaagcggcgaatagaaaatgccgtccagcacaaaggacacaacaacaaacaacaaaaatccaagaatattcgcgtgccgaacgagtgttaccgagagagaggacgagtaggggagggaggcgagtcgttagtctctcgttttggtgtatacactgtgcgggtgagacagctgtgggggtgtcaacaggtcgagcacagcaacattacctgcgcccaagtccttgttcttgcagcttgtcacgtaggcatccacgcttatcgtggtgttttcgtttcctgggaccgtcactaggcaaggctggcattttgctgaacgaacacagtagattcgaaaagatagacattagctgacaagcacgacgacaggaaccggaccagagaaggggcggcggcagcgtcttcacatactgtaatcggcaattacggtgggtgtgcacaggcagttgagcatctcaggagtgatggttctacacaagttagaacagggcgtgcggaaagagtggacgatattcagtttgaggaagccaggttctgagatttatcctagcggacgcagggagcgtccaaagttcagggttcacagagaatcgtcatggatccttacggagcgtaaagcgcaccacactgcgtggagtcggtgtagaacgacatgcagtctctcgcgaagcactggacatacgacatggcgtagagtgttgctcaagcggtgcagtaggggtgcagtagtgttgtgtgaggttcaagtgaggcacgttcctgggcgaggagtaggcgttaaaaaataaatgaagatcaagaaccgagggagaggaagagggtggccagagagttgggaaggcgagtggcgtggaggcaggaggcggtgggaagcgagagtgtggagtggaccgggagggtgggaggggcagcaaaggaagaaggaagagaggaagagcggaagagaggaagagcggaagagaggaagtgcgaggtcaacagaataaaagatggggctctcgcatcagtgcagcagagccgcacgctcagtggaccagttctgttatttgtcatgtcatggacggtgaggcgctgcttccgaggaaggcccgatacggttcgcgcatgggttgtgctgtccatcctagacctgctggatgggtgatatcatggtcgctcgtgcggactgcatgcttccagggaagaaggacatgatgggcccaagagtccagctccagacacaagaacaaaactctaaagctctcatcgattctttattgcagtattttgccactgtgtcgatcttcatagaccaggtgtggcagggcaagcgcccaagggcgaactctattttcagcgcttgttgacagagcacggagggtgctgttgaagcgcacacacagctgcagtcctcgtggataaacaattctcgaaggaccatgacctcgagaggccgatagagaaagcagacggaagaagggaagcgacatcgcagacatctccgggagtgggcgccgagaaggatgttttcagtggaacattaagggtactctctactgtacgatagaaccgacccaaaggatgaaaaaaaaatatgcttctttcaagcccagatctccacgcctctgttcatgtctccacagccaacagagagatggccaatggaaccctcatcggcgcctcagcagactgtttgtgagaaagcaggcagttcaaggatgtcgaatgcagttgcgcaccggctcccaatgaccatcgacctggttttgtccgtgcccgcaggtctggaggatgtggctgtgcgccagttgccaggcaggcttgtggatgttgccaccgatatcagctacgggactggatcagggtacttggaggtgcgcatccttcgcttggacggtgaccaggatcctcaggacgagaccgttgaaaaccgtggcgaatctgcccttgaagtgatcacggagctggtggcacatcctccattgtgcatctttggcgcctatgtggccatgggggacattgtcattcctcaagcgacatttcaagctcccaaagatcttttgacctatgccatggcaggcttccagcagccacaggagctagactcggatgaccagagcctcgacatgacaaggaagcctgtttatactggaggggaaggggtagatctgggactgaggtggcaggatgccttgtctgtgcttgaaagcacccctacacccttggcacaccgactcgcgtcctccaggatcgacaggaaggatgctgaaccgcaagccccgatttgtttccgcgcctcgtttgatcggggcgacgtacaacacaaaggcgtacggtctcaagatctagcagctgcacttggagggttagcaggcgacgtgttcccgtcttggaaggtcgatctgacgggatacgacgtcgaagtgtttgcaaggtggatccagcaagaccaggaattggttcagtgcaagttgagagcagcctcgaggtcgatagtggcaggccctaatcaagccggtggcggcaatgtaaacaaacgaccacggaccgaaagcgactcggaggagacgactgcagcgaggaatggggccaggatgcaagtagggatgaccttgccgctggcgctgtcgacttgtccctatcgataccgaccagtagatggtcggacgtcgctgaaaatagagattacgtacaatctcttggcgatggcggccccaagaccgggcaatatcgttcttgacatttgctcgggcgtagggacgatcccgatcatcggcgctgcacattatcctgagtgccttttcgcagggtttgagattattcctcacaatgtcgacaaggcagtccaaaacgcaagagagatggtcccgaaagcggagcaagagtacagagcaaggatgacggaccccaagactacgagggctcgtgtgctccctagcctgttcttgggggacgccagggcagtctgctggcggtctgggacggcagatctgattatcagtggtaagtgtagcgtatggctcattcgccgttgtccaacgttgtgtttattctgttatgcatgcacgttgttaaatcgtctagtggaccatcctactccgtgactagatttgccctggggccagagagagaactcgcatgtgtacaactgcaaactataccctcgcttgattaaggaggtcatccggttgctcaaggtcagtggacgggcggtccttgtgactggcgagcgcaagctacttcagaggcagctggatgcgccttttgcaaggccgcacctgaggctgctccagaagcgggagatcacaatcgggtttaaagtgatgatttttgagttggagcgcatttgaagtgctcaacattaaatgagcgtgagtggccggtgcttttcgtatttgtttgttagcgccattggcctcacatgggctacaggagattgcgattcacgatggttgcgccggggttgccggggaaccggggacccggataaacgtccgtggggattgcacgcgcaggcatgcagtcgtgtgacgactgggcgcaggccgctgtggccttgtcacttttgggtgcacacggacaaaagcagtgagacagattgggtgcggtgcgagcgcgatgtttcatcccgcgaataggaagtcgagaaggcggtcagtcatccgtcaacaatcacaaggaaaaaaaatggtctcgacgggcgagggcttttttttcttcttcacactctttgttccgttgtttcctcatcaccactcgtcctctgtcctgcttcgcggctgctctctcttgggtgctctttcctccagcaagcacgacggagactggactcaaccgatcccactcccccccccctgcatcatccgccatatcgtcctccgcatctgcatcctgtgcatcctgtgcttcatacggtgtgccaaccttaatccgaccaacagtagtcgctcgacaatcttttagccaaagcggcctttttttgcttgcccttcatctcttgctcccgccttgcgtcgtcgtcctctctccatctccccttctctcgcctttcgtacttttgcgcttttgcactctccttctccctcgcacattcacacctcacgcccgcccgcacgcactctctctctctctctctctctctctatctctttgccgccacttctggatcgtgttgcggacacacatatgatgcccttgggcctcctcttgcctctcgttcaacttctcacggcggtcgcaggagcaacacccatcctctctagccatgacactacgatcgcaaacaactcttcgcctgctgtctcgcccgttccctcctcaccgcctttcttagcgccatccactcctttttcaccaatgtcttcagaccatgcctcggacggcgtctcgtcactgactccagactccgcatccgaggatgcagatctttcccggccgaacctaccgttcgccatggttgccaactggctcagcatgattggatcgctgatgattatgctgcacgtccctcgggtgatagagcaggtgcccacacagaggaagcggatgctcatcatattcgccactgccgtctcgaactttgggttttcttttgccaacatcatgacaggtaagaagcagagagacgaagggtcttagcgaggtggttcaagtgctctttgggagcacctagtgagcagtgattcaaccgtaacgggtgcttgccacgcatctcatagtcttgtattcttcggtcgtacatagatttcacctcggcaaacacgtttctgccatgtagtatatccgcttggtgctatgtatgacgattgtgcctgtgcaatgtttcaaggcttttctggctcgaatggagtccaggacactatctaacactttttttctgctgcctgaaaacgttgtcctcattcacaggtctttttccagctgctgacatgcatgttggtcatcgtcagcacgttccggctatgcggcgtgtttctttttgagcgtcgacggtcaatcccctccaagtacattgccctctgtcccttggcagcgttcattctggccaccgtcccggcgatcgcgcagcagtatggttttgacgaatgtgcccattattgctggttcgtgatcaagcactaccaacccacttgccaggagcgttctctctgggcatatctgtgcttttatgcctggatgatcctgttcctccttatcctctttggatccacgctctatgtcatggtccgcatcgccatatccttcatgcacgttcgctcgagagtcaagcaggtcgtgagtcagaccataaaacccgcctctggtgccgagccaccaccatctcctcaaatgtcggcgtttgagagagttcgctcactcagttatcgtgtcaaggataaaacagcgtctttattctcgggagacagcagacgccagcaaggatcgtcagtcagccatcaggataggtcaggcgatttcgtcactgatgccgcatacgcggtgggccagcgtcgtggtcagcaaggcatcggctcgagcagttcaccatcgccatcagcaacacgctccgagaacaccaccaccttccacggacacaattcacaggctatccgcaacgaaagcattttgtccacatcctttcgcgacgacgatgctttgtctcgcgaagcctccaacgcagcctcaaacacagcgagtacacgggatccacgagcgccagcacatcatctttctgcaagtgagaacaacatcattcgaatcaatgagcggacactattaatcgccattcttcgacaagcgctctacccgatctcgatctccgtctctggctgcatccagatcattgtggatttgaccgtgatgactcgtatcgactatctacagacactcgattacgtcgctaatatcgccactagcatccaaggatttctgtttttcttggtgtttatgtttgatcctgccgtggtctatacgcgtcgtcaatggcgaaagtacttggtctggaagtactacattgagttttattacagtctggggatgccacaggagggccgggtgttccaggaccagtttatgcagcggtgccaacatactttggtcaggagcggcagtaccagggatgaagccaattacgacgtctttctcaagcagccatcctactcttggtcgctccagtacgataatctggccatgccctcggaatttcaaacggcatacccgctcatcaatgtcagcacaccaacggatgccgacgcgccacaagggcaaggaaacggccctccagatccttcaggaagcaattctgcgaatgtgtctccgcggcctggtcctaaaaagacctcactcagtcgcgcaggaggtgcgggagaaaagttgccagacaagttttatggatatgggcagtacgggcatggagccaccaggacagactataccccttccgtcagcgatccgtcctcaaaatcagtgacctctccgattcacagttgtgcggaggaagagggccgatgtcatccgatggccagcgtgacaatttctgatctccctggtaacgatagcggcgaccgaagcaatcctcatgttgcattttatcacgacatgtatgccctcgagaatctgaacgtgtccaacgcgtccaatgagaatgatggaccagcgcgtgcgactggccaggatacggcaccatcagtacatgcagcaccatcatatcaaattcatcctaatggctacaggacagctcatagaacgaccgcccctacgcacagccacaaccacggacaacaaggcgaaggccgggagcagctgcacctccctcgagtagacagacaccaccgctctcacgacatcgtcgatagcgaggtctctgcttgtggcagtcatagtgatgccagctcgggtggtgaacacagttacagcggcacggatggagaaggtgaaagtgcagacggagcaaatggctaccatcatcgtcaccatcaccgccgtcgtagggcctccctcactgcagccaatccaggagatgttctttccttccctcggctggccaaagtggccaccatcggtggcagtgtaggatctccctcgcttcagcgattgcgaacctccaccaatacggccactaccgcgacaactcggccttcgaaatcgtcctctgcaggccggccaacgttcatgtcgtctagcgaccggtcaaacagcatgcgcgcgtcgctgaaagagcgcttcaagatcccgggtcttcgtaacattcgaggcatccgtcgtagagacagtgtgcttgatattgagcggtaccagacgaggtttaagtacccgaaatgcgcgtatctactccatatggtggtccgacggctttggatccctagagaggtcaggctaccgccaatagcgaatccacttaggaggacgtttgctagccgcccggtcagtattcacgaagcgaataattcccaggcggtgctgacagtcatggaggcaatggagatgtcgcagaatgagccatatcgagagagcgtcatgtacacagatcatgtagggacggtggcgcccgagcagcaacagcacgaggtaggggagggtataggtctttcacgtttgcgcaacgagcggagacatgaagaacagcacgttatacccctgcccccattagccgatggcgatgactatacggctgcatgagtgatgactgagagtagaatagtaataaaagggtgacgtgtttgcaaggatcttgttgatgcctcctcctcctcctcctcctccttttacactgtcattcatcctttccacccgctttgggacgcttttcacgctcaggacaatcttttggtcgacgtctctgtggaatacagtcatccctctctcacacagccgccgcaggccaatcgctatgggcttaccgcagttgctttggcaacaactgagaggcgctcctgtttttacccaagtactacgccccaaactccaaatgtgccagcgtcagatatgtggctatggctgtttgtgcttcccggcagcttcacttgcagcagggcgttacgacgataccgacacagatgcactcaggtgggtttgagtccttgagctggctcgagaaaccggcaatgcccatgtgtcgctcgttccctcagtcgacagacgtaatgtcccccttctctctgcataaaaaaagaaccccaaaaggggtcaaaggagcgcaatcgaattctttcttctctcattctcctccactctccctccctccacctctgccgtccttttttcgctttctttttcgtttccccgcgcttgtccttcactatccgtttttgctgaatacggcttgcacccctccactagcaccagcgcagcacgaaccagttcctctcacattgaagtcccttcggtcccgtctcacacttctgagcgtgttcttcctcaacatgtcagccattgtcagtgaccccatcgcaacagcagaggcctcttaccgtagtcaccaaaccaaccacaaagtcaagatctttatgcaagtatagcgaacacccctgttggtcatgccaatcgttgcgatagtcctatgaaaacgaacagtgcgcagtacctcgcctcttcctgatcccgcacacgagggattatggatggtcgaggaggcaactcgccgcattagctgcattggccgaccctccgactccatcaacatgtttcgcttttcgacatttattcataatgcgctcagcttttttttttcctccttgtgtcttgtgtactcttgtctgaccatggtccgtgtgcggctttatttttcacataactctaatatttcacacctccccccctcccttttcgcttctctgtcgatcgaaaccttcttctagaccatgccactatgatctctcccaggtcgagacctgtgcgccctttctggaccgctacggtggagtggtctttgtctacgattggaacgtggcaaaggacaccatcacgcagtactaccggagtcagtaccctgacggctgggttaaagtcgcgcccttctcgctgagaaacatcctcgacgccatcaagaatctggaccatcgccttgatcggcatgaccctccggagcctcgcggcgatctcaccagcgacgtccatagcaccagccaccaccgccggccgctagagaacgccaatggcagcaatgacagcatccacagcaccaccagctccgtgagcaatacgagcaacagcagcagcggcagccacgggcaaaatagttgggaggccaagaagcaacacaaggttgtttttctcttgacgggctccatgaacccagactatggcgtgtttggcctcacccagaagttgatcctcactgccatcagggatgctatgccggagcggattcaggccgtggacgttattgggcactgtatgtacggatgtgcgtcctgcagtggtgtggagcacaaagtgccgctgtactttacacggtacttcaataagacgtaagatgccacttcctgctttttgctatgtagcaccatcacgatgtggtcattgctccccccctcttcccaacggctaaagtcaagctgtgctaaccacaattatctatacaactttataatggcgctagactgccctacacagcgcaagatgtgcgcgcgttatatgcttcaccaaagacagacagtactgccagtggcgcacatgcggtccttgtagcaccatcctgcggcagcacgtcgatgatcgcccaaaagcctctgatccagctctttcaccgtctggagcaaacgggtcgatggaaattcatctggaagatgcacccgacctccctgcatctggacggttatgacactgaggacgcctctggcgtggagcaagccgagcttgagaatgtcaagttcatcctggcgcactttaccgtcaccattgaggagcacgcgtgtttgctgccgttcatggaagcatttgatgtagtcatcacggacttgcattcgtccgtgcccttcattgccacctatttcacacccaaagtcatcctctcctactttaacgacgctgattatggaacgcctgagaggcatcaagaattcatggaacaattgaacacgtttattgagccagaggaactggaggcgttgttgaacaacctgccggcagccaagggagaccagtcgttctttcatagccagtacggccatgtggacggacaggaggatttgaagtttggccacctggccaaatggcctactgagcaggtagcaaagaacagcgcgattcatcttgcaggtgttcttgtgcgcagacgcgtccttgttcatcgctgacgtctttcacggtcgtgatgtattctctccgcttgaatagtttgaaccctcacatccattccagtatcgacaggccatggcccagttggcgttagagtggaaaaagatttggaagtccatggtcgaaacatacgctgacgatgtcgagggcgccaacaacgctttaggattcgatggaaagtttcccctgctccagggcgaggacagtctgacgctaccaaaaacgctacccagagtgttgccacgggagcggagggctgccggaatcgagcttaggatcatgagctttaatatttggaacggagggcagtcgtctggactgccgctggagcaaacagcaaaagccatcctggcctctggcgccgatgtcgtgggtcttcaaggtaaggaccaaaaaatatcactagtggcgcctttcaagccccaactggcctttatctcagccgtagccattgacccactcctgttattgataccgttttccacacgattagagtgttcgtcgctgatgggggcatcgggtgagcgacggtatatgctcccagagctgatgcagtacctccctggatggtactacagcgaccaaaagctccggtcggtcagcacaggtcctcgcaacccctggggaatcgtctccaaatttccaattgtcaacacgacagagttgggatttggtgtcaagatccagctcaacaatcaccggcaccccgagatggaaccatcgtattacagagccctgtccgatgaccaatatgcagccatgtccgcccggttatcccattcgccgtcctccctgacctcgcccatatccatgatggccaacggcggccagttcctctacagagcagcacccaatacccggttcatgtatctattcaattgccatctctactacttcccctaccagcccttccagctgctcaagataccttatgacaaccagccgttcctcaacacggccgaagaagctgtacagtcctgcatagaggcgcgtggtaaggagatgcagctgattctaaacgagattcgacaagttgccgaacaggagcaggacgtgcccatcttcctgacaggtgactttaacgagcccagtcatctggactggacgcccctctcggttatgacaggcctccaacctctgcaggtggcctggcccatgaccgagtgggcctacaaggctgggctgattgacttgtggagagcgcaccgacctcatgtgcctggatccggctcctcccccaccagtcctatcagtggccgagacagtttcggcagcagcctcagtcacctcaccgatacccatccgaacgccggcagcaacagccctccatgcgcaaaaatgagccccaagcacgaagaagacgaaacaatgggcgaggtcgagagggcagagcaacaagtgattgagcgaccgggctttacttggacggcgttacgccgagaattggacgggatggatcactacgatcggatcgattacatctttggattggatcgagaatccagtcctattgcgctcaaggaggtggcgatcaagatgggcgaggagttgtgccgttctggggagaagaacgagaaggtgttcaaaccatggccttcagaccatcgtgccgtgattgcgaccgtgctcttgtaaaaaaaagtcctcagtacagtacctcttgagccgggtagaaactgtgaaacgggtatgcataccccccaacacatagtttacaaatacagaataggataaaaacttggttccacacagacccagttgtgcctggatcatctcttggaccacccgagtacgggtacattgtgtcaacaatgtatcatcatgtccgtccacctttccaattttagtttgattatgcggtgtacaaaaattgaaacgacagattgaacgtccttcgctgttcggcgttgtccatgtccccctaccttgtcaccaaggagcgatggactctggtctgcatgctcatcggactttacagttacacttgatgcaaaagcccatatactttttctttttttttttaaagtttgtccacttgctcaagagcgccacaaatggaacagctgttgcgggaaaaaaaaaggaacggtaaagggctcacagttgcctttctgcttatgcgatagtcttagacttcacaatcccgtaatgactggtgatcaatcgccgcaggagccctctgtgcgctaacaaaagaaggtgtgagaaaataaagaagaacgagcgaacaaggcaaaacacaccgttttctggatgacaagcaggtttattaacaatacaggtagtgaccgagatatacaacgaggagaaggaaaatatgtaaaggaccatgcttcatgctttgtttgaaagagaattatgagtggggggtgggtcgagaatcagggtggcggttgcaaacgttggctgagctgattattcgctcctgaaaagtcgccggtgcagccaacagctggtcgcgattcaccgtgtcctgaatgttggccaaggggggggggggggggggggaggcctaatacttcaggataatatagaaggcatggatgatacctgcgatgcggacagagtgaagggtgaagaaggcgtgagtattccaagtgtgccaagcgcgcagaaatgaagctgctgatgataaagaaagcaaagcgtcaagtcggagcgagagagaatacacgtaccagggatgtatcccagacaggtcaaaccgatgttgatgagcaggtcgcagccgcagcccttctcgaggaggactcccagaggggggaggatgacggcaaagatgaacttgaagatgtcggagcaggtaagagccatgttggattgtgtgtatgtgtaggtggtgagttgagaaatgaaaagagaagagaagagaagattggaaagacgtacagcacgggtgccctttttatgggagcaatgcggatcatttagctgctctgctatttttttgaagtgcgaaaatggaaatctcttggcgaccgccccgctccttacatcatcatcagacagtggattctgctctcgatgatatcattgtcacatttcttgaggatcaaaggtgagtggtgtgcaggagggatggggcgctggcacgcttggcacagttggcacactgcatccgcgctcataccattgtgcctgggcagagtccttcccctgttcgtacctcccagagggaatggtgctctcaaagccgtttcaggggaacaaccctcctccgaagaaacaccttgcttcatgacgcctcacattctcctcccgccaacatgcacaacaacctttctgtgtcccccttgcactccgcgtaacaaggctcactcagagacgcagacagggttaccgatgctcactgctatcaaacagggatcaactgccgtgtccgccatgacgatttagtttccactgtcgaaggcagcgaggtttcgagccaagcgcgaaagttgttcgaccctggcattgtcaaatgcgctttcaaatacctctggcggcacaattgatcggggaagggatgtggactgagaatactgcattcatcctctcgcaaaaaaatcatacttatcttgcagttttgttcataggcctgggtgcataatctaggttctcacagcatacgaaaagatctacagcatcttccgtgcactgcttccagtatacccgtcacccactttggagttttgagatgaaattggcagctcccatcctcagagttgaagccgagctccgacttcgtgcaaactgctttcgcagcactcagcacagccctcttttgcaggcaaccttatttttgtctttgcaccttcgctccccgtcattcgtatttttagagtgggatagagtcgactgctgaaaagttatgctataaactctgtgccatgcgattgatgatagtgtgtcgttcttgtgaacgtatgtcatgtgggagtgcttggtagatctatcgcatcgaagaaacattgcgtaaagtagcagtcggcagtgagtggggcggtagtttcgaaacacaggtatcaagttcaaaagatacagtttcaggtctcaccatttgatacttggtgacagtgtctttatcatccccttccagaagccgcaagatgcagtcgtgcaggagaccatcgaccacctgagtgtcaatcgcatgggcggggacaacaaacctccgaagcatcattaggtttttgaacaggcctatcgtcctccaaagataccgttctcgtgcctgttctccttccgtcgtcaagatgtgtcttggcgtcaatggctgagccgcttcaacaaactggtctcgatgaacccgagcagtctccagaatcgtctgcgttgtggctttcagaagctgatccatcttgttgtccttcttgtcgacatagtccagtagttgatccagaatagccttcaagcaccgtgtttgctttgaggaatacaggtcaacgccctcagcattgagaaaccttgtgattttgggacaaaggctctttgctacgaccttgctcatcagatccttatccatgtcttcctcttcttcgtcggggtcgctttcagagtcgctgtgcatacgtgaggttgaggcgtgaacaactgtgtaggatgaaacagcgtcgtgccatacttgggttgatatatcgtccgatactcggagcgggttccataggcagatctcttggcgtacgaaaaagtcaaagactagaggcaaaagcagaccgccataggccttgttgtagtccctcgggtattcggttttccatgcttggaagtgccgcttgactgcctccaatgacttgaactctgcccccacctccttgaagatgttggtacgccgctcatccaagtccatgagagcactgccaagttctgcttggtcgccagcgcccagttcgtcgtccgtcgacagaccatccttatcctggtcctcctttgctgcaacatcccgggtttgtcttctctgggactgccggcgcgctctatcagctctgcgcctccttcgcacagccattggatcgacagcaacgcttcttccgaactcgtccaactcctgcggttcagccttcctgtgtgcacccttggactcgtcatcctccacgacattagcgaattctgccaggtcgtccttggtgtcgagccgtctcctttcaatgacgacctttgtgcggtctgagagcaaagacacgtattcctgttcgattgattccaattcgggatacttttcctcaaagaaggcggccaagttcctacagtatgtgcgcagctcctgaaagaatgtgtagcgtgcgctggccttggcaatgtcttcttccgcctcgacagctctcaacgagatggaggcttcctcgtggcggatctggctcagctgcgcagcgtgcatggcatgctgctgctgcaaattaccgaggtgtccttgcaatcgtttcctgacctctgcaatacttggcacttgagtgaccgttgggactagaccagacagaatgcaaagagacaagtcagattgagagtgagtaatggtatttctcgcaattccagcagccttcctcagtatctcgcaggcttacaggcaacgctcttgtggacgacaacagatctcttttcctttggagccttcggaacaacgccggcactgcgaatctgctgcagctcccattcccgcgtctcctcttggtcttcgtcatcctcatccctatgtgtgatgatattaccggcggccgggcagttagttgtctcgaattctagcgaggtgtgtatccgtcggaaagtaaagccacaggctagcactcatacatatcctcgagcatctctttccgagcagcccgttttttcatttccgctaaccgctgagctttggagcccaatgctaatttgtcgcccatgactttctcgaggtctatcgacaaaagacgttgctgttaaagggtgatcttgcaatcttgattctgaaaaggtcatctacgccagtggcaaagcgcttgcttaccagcttcaccatcatccagctcatcatcttcttctcggatcaacctcgtgtcccgttgctcaacaacctgtttgaatagaatgtaagaggcgtaaggtttgtatcaagacccagtatatgtttgtatactccagtgccgtcctattttcgtaactgatccttacggtgtcatcgtcacctcctgctagtgatataaactcctcttcctcttgatcattcctgagtctcctttgctcccgcttcttctttgccaggtgtatagcattagcgtcgggaatgatggtaggtcctaatagaaaggaatggggtcagagttcattcccagcggatccatgctgcagtgtcgttgaggagcacatcgcgatatgtcgtacctccgagttgagtagggaacttttcctccaccagactttcgcccactccagaggatttgctggaaggtgctgtcgacagagtggattttttaagctcctcgagagcttccttgctgtacgacactgcattccctacagtcgcacgacttgagatggcgggctgctgagtgctccctgatccttcctgtcctttgttgtgagcgagcctccgactagcagagctctttttgattttaaacgtcgcttctgattcctatgtagttggaagcgcatcaaaagaatatggtctcagcagagggtcatgcatagtttggagacattcacgcgagcctgatcaaagtccttgtctacttgcctcttcctcatcaccaaaacttagggtggtgctggcgacctttttcttcactttcttggcttttgaagtcggagcagggagttctagatagcaagcacaagagcggacagggtgaatcaggttggaacgttgcatgggaggtgctgcgggtgaatgggcttcaaccgtaggcgagctgctagttgatacctgcgctgtccctcgcaggcgtgccaagcaaagtctctgctgcgctggagtcttcgtcgtcgacatcgactttcttcctgaggggtcgatttttgcgaggggtgaacatggtgaggtggcggcgatgcgggacaggaagaaggctgtgttgaggagacctggaccgtttacacagacgttcaaaattccagaacctgctgtggcttgaatgcactgaaatttccagcgcgtcccttctgacgcgctctgatacccatctctgtccaaccctggccctgctttgactctatcgcgaagacgtgccgcttcgcctgccttcttgtatcgcagcaccccacagccccgtaaagaaggcactgcaggatcagagttcacttctaaacgcgtcgagttagcagaagcggtagagatgaagtgcgcgtttctgtcccgaagctgtgccgtacgaggcccatggtcgcgtggaaagagatgatgacgtctcactttcacgctcttattttttgatatgtgtctatataaaacctttggctctccttttttcctttcatcacacatcacctccatctcatcatcctcatcttcattcatcatgtcttggcaatcatacgttgacaccaacctcgtttccaccggcaaggtctccaaggcctccatctttggtctggacggttctctttgggccaccagccctgatttcaaagtaatagaacaactatagagtttccttcaatttgttctcacaccctttgctccggctggccaccatcaaggagttcgaggacccactcagatatctttcctaaacacaggagagcatcatgacacgaaaaagaacatgctgtcgaactcgacccatggagccttcgtcctgatggactttgcgcgctgatcacctcgctctttaacggtctttttttttctacgtacttctcgacatgttcactaactctgaagtcattctactgtacctacacatgacttttgtctagattggaggcgaggaagtcaagaagctgattgccgctttcaccgacatttccgatatcgctgctaatggtctctacttggagggtgccaaatacgtgttcttgagaaacccggacaatagcatttatgcccgcaacgtaagtccaatgccttttgcagcgggagtcatgactccccctctactggataataagcagagtgctgcatggctctcgtcagatcacttgactactgcagtggacgtgcccatgcctttatctgttggtcggatgatgtgataatgtaaagggagaacagggtcagagatgtgtcgagggcacgggtggccttttcttttgtcatcttcgccatccaatgggtcagcagacagtgtatccatcaaatcgatggaatatcgcgcgtctgttcacatccttgcgatataagggggttgcgcttcccgcggtatggagcggcggtttgtcggggtacatggtgctcactagaataagacaagcgcctgcccggttctcaatctatttatgtcaccctggctcaaatcccaaacactttctggctccaccctcacatcctcttaactccatgtctatggctacttcttaatgttttagggtgccaccggtgtctgctgcaccaaaaccagccaagctatcattgttggctactacagcgagaacatgcagggcggcgattgcaaccaagtcgttgagactttggcccaatatcttgtgggcgctggttatgtaagctgaatgcttcttgctccacttgcctgctatgattgcaacatctggatcaactatactgaagctgtttttcattttgctttagtaaacatgttcaggcccaagtcccagggtccaacaggtccatgttctcaatcatatacgtgcagggaggacgccgcccagttgccttcaagatcgagcttaagaagatcgatatagtaaaaaaaggcgcacaaaagcactcaaaaaaatagttgatacaaaaacgagtattacttgtagcctgtatgtgtcattcaagcctcgtcctcgtcatctcctgctgaggtcccttcagcgtcgtcttcatcttcaccgtcttcgtactcatcctcataaccattgccctcctcgttatcgctgccctgcaaagcgtccacctgttctcgcagcacgtcattatctaaacaaaggggcgaggtagcatggtcaaaaaacgcaactcctcctctagcgaaatgttccttgttcatcgtgggcgtcacttacaagggtccaactcgagtgcgcgcgatagtttctcggtcgcagcatcaaatcgctccatgataacatcctcatcatcgaccaggttggtggacataagatatgcctgtcccaactaaacagcgagaacgacgcatttgctgtcagtgcgatatacatacgtggtttttttcttacagtaccaagcagtcataaaacgatcaactgtacttacagcctccaacgtcttggcgtcgcccgattcactctgcaactcttcagccttggacaagaagctgatcgccttttccacaaaggtcgttgcaggattctggtctcccgcgttctggttatcgacgagccttgctttgctgtagaggcacgatccatagatcgtcaacacgtccgcattcgaatctatgaagtccgagttggctgactgaacatgctccaaatgtttaacggctgagtcaaacaccttcctcgccagatctaaagtatggaggcatgttttctgtgttagtatcaccaactgctgatttgagttcataccgtccagtgaacgctcttacctgcattgagtctcaagtccagggagacgccatattcctccagctcttgcgcagcgcggatggattcttgggcataggagtcgattttggtcttcatcagcaactcaagtcccgcattgaaggcttggatcgcacggtcgaccagctttgcctcgggtttgccaataagcgcggctgcctccctttgttcgtcagaaggttcttcctcatcgtcatcatcctccagcgtcaacgtcttcatggcctgcttgcgcaaatccctagcctagttgtggtatcaaatcaagttaccatcaaaggaaatagaaaaatcgcagttctatcatgagtacgaagggacatcatagctgagatcaagtcatcttccagtggtgcccccatacctgactgatcgcggcgatcccgagacccaccaacgcgctcccatcgcggtgctccatggtcttgtccagatcctcaaacatccttgttccttcctgcaacatttccgaggacggcatcgcattcccgactgcaaccatgcaggccgcatgctgaagcttaatctctagcgccttggctgcagcttcggatccatccttcaggtcgacatgtgtatgggccttgtcctgcacctcgaattcctcgatggccttgtcgaacagcgccttggccatacgcgacatgcccgctgattcacccgagcctggcttggaaccagcaacctcttcacgcgccatctggaacaggtccacagcacttggcttcgtctcgaactgaaggacgacctcgccctcagcacagccctcacagcttggatcttcgcagtcctcggcgtgttgtccgtctgcagcctcggtcctgggcttcttgggttcgtgccggtcgcttacaggtgcctcgggcaaggaggccttgcgcttgtgagtggacgcgtcagtggggctcattcttcaaggtaagtggactgttatggcagctgttgctctggaaatgagggggtagaatgaggagggaatgaagaaggggtgggtaaaggaggcgggaggagagaatgagcaacaacaaagagatcaatttttctgtctgcgctttgctcagcttcaaggggataaatgatgtgcagtcacttccccactccctaagtgaatcctcacaatcgaccacatcattctgtgaaaagcaaaaacagatatcttttattgcgtctctcgtcttcatcccacactcccacacactgagcacttgtcgaccacttactgctattgtcacacaaagcaaacgagaacacgaacgtgttagagatcgtcggcaaaaagaacacagcataaagtcaaaccagcttcggccagcaccgatcaacatccagagaacatcgacacttacggcagcagcagccttgacacgctgggcagcacgcttgccggtctgagcctggaaaccagatttgatggccgagacggatctcgtcgatccacaggcctcgcactgcaagaagaacagacggttctccttggtcaagatggtatcgggcgacttgcaggtcttgcaggtcacatactcgacaatgtaacgacgcaagacggcctcgatctgcttctgctggaagcgacccttgatcaccaaacgctgagaaccgtcaatcgatccagaagttcccaactccgcaaacaagaactgaataacgtgctcgggctgacgatgcatcctcttgcaaatatcggcgacgttggcaaagaccgtcttcttgtttccatcacgcataaccgaaggaggcacaatcgtgtaacgcttcttctctccggcaagctcggggttgttctgacgcaagatcttgaacacacgcgagaggagctctgtgtaggtgtagtcgcggttcgatccgatccagccctcctctgcctcaccagccttcgagctggaacgaggaacgccctcctcgtcatcagcagcaaagatgtcatcgggatcacgcgcaccatcctcgccctcctggtcctgaccatcctcgaatgccgagaaatcaaccttcttggactttttcttcttcttcttcaattcaccaaagtcgagcgagtcgccagcctcaccggcatcctcaccgccctctgcgttggcatcatcctaaacaggaatagcaatggatcaatgagcattattggcatgtcagtaactactattaaccttcaaccgccccattggatctcttttttcttcaaaaaagaacatggagaccatttcgacccgattctcgtgatagagtccttacctcaaccttgaccttcttcttcttcttcttcttctcgccaaacatggccataggatcctcctcagcagcatctagagtgaataggaaaaaaaacaagcacgtatgcaaaggcgatcagaaatgagtcatagcagcagtggtctaacgtctccttgaattttactgcggcgagagaatgtatcgatcatcctatcaatggagcaaggcaatataccagtgggtgcggcttcctgaacctcggcagcagcctcctcggtgggctcttcctcggtcttctttgactttttcttctttttcttcatggacaggtcaaagaccagctattagggaacgagagaagcacataggagagaaagaaaaagtggaatcgttgtaatcgtgattagagacgatgcgagacgaaaaaaagtgtaaaaaaatatatccctgaagaccgcgagtttccagcgcaatgaaagagtcaatgtgcaggagtagtcggggtgtgcgaatcgcgatggtcggatggcgcgcttacttcgtcgtcctgaatctccatggactcgagcttctcctcaatttcagcagacatgatgtggatgtgtggtgttgtgttgcgaaagtgcaagagaacaatgcaggcgacggcgcatattttgaaccaacagacaaagccaccaaaccaatgtacggaacggcacgtgatttattactatacaaggttttttacagtttgcaaggcgttcaagcggtgatcagtggcccttttccagctctgcccgagccaagaacgctgcccgcagttgtgcgttaatatcctcgtacacattaggaccaagtcctctgctggtcacttcgccaccataaacttgctgccgcgcatgaggcgtgcgctcgtcacgaagaaactgctgtggctccgtgagctgctgatcctgatgaggaccgcagaaaagtgcccttccgtcatgaccctcatcaataccctccatgtcattatcctcatcatccaccagcacttgactgttggaagctgaactcctttgcgcttggtgccatgcagtgctggctgtgaaaggtatatgctggaatccatgttgatcctgttgctgctgctgttgttgttgctgccgctgctgttgttgttcttgttgttgctgtcgttgctgctgctgtcgccaagcttgcacgtcctggctgcgatccgacgatatcacagtttctgataatgtttcagcgggtatcccgtaccgcgtcgcatgtatctgatgaagtagattgttcattccatagtacacagctgcgttagaatcttgtggatacacatcgtatagggcggcgggcatatccgtggaggtcgagctcggtaccgcgtctctggactcggacgactttgtggagatacgaataggccctagcatccggggctgatctgcgcgtgttgcatgagggtgctgctcgtggagagatcgttcagggacattgtatggcgtcccatatagagcaatactggtggcatccaactgattcgtggaaatgctcaagctgtcgtaggcttccgccggtggcgatctacagcaacgttggagacagagtcaggacacaacacaaaagtgcagataaaaaagtttaacagcagcggtatggactaccataaacacttttgcctcaaggtgacttactcagaatccaacttgatgcgcttcattttcctgagaacgcgaccctcgatactatccgcgccaccctcatacgcttcttgaatattcacactattaggccaaacgtctgcagaagcatcctgatacacttgcgcggagggttcgttgacgtccggcagtagagacaaatctttcagagctgcgtcatccttttggaacgtttcagcatgaagtcggcgcttcattgaaacgcaatgctgagtggactgacaagagggcaatgctagtgcggctctgagtgggtatggtgtgatggtaaaaaagtaaggaatgctagggagactaaagagagagcttgaggagcgattcggattctcaagcatttctggaaggctcatggcgtctctttgcctcattgacaaagtgactctgccaggcaggttcaaggagggcgaggtaggcgagagaagcaatctttgctgggtaaaggaggaacgaggaggaacgagaagagcgacattgcatgtcaaaacacccatcccagtgcgcggccaggcagtcacgcaccaccgcacagtagctgaaaaaaagagatttttgaattgtgcgacataaatgacctctagactggcagcctctgaccgctcatacgatcgacaacctaaaaaaaaataattcaagagggctgtcagtgtcaaggctttgggactacatgttgtcaatagctgcaaagtgtccaaaaatcaccttggagatccctggagcactcaagatgtttccaatgacgggcaatctcctcaagaagccgatgatgactgggaaaaagtcgctagagaagatagtgaatccattcagaggtatcgtttgttaattcccgcaacgcttggacatggctagcactaccgttgtcaatgcgtgcatttcttacccgaacaggttgatgaatccaaagagctctacgatcactccgatcttcggccacttgataaagaccaagaggattccgccaaagaagcagaccgtcccgcgaaccttttgacggcgcgcgaagaaatatatcgtcttttgcgttccaatgaccagtgtcaatccagccaagaacaagatctaccgtagcacgtgaaatagactctgccatggtcagtcctactgcatttgaatgtccatcgttatccggcgtcctgcacctctacaagagttgttccatgataaaagaagctgcatgactgtccagaggcttccatggtatgctgggcgtatgagcttattacttcatcgagacaccgggcccacggtaagctcttggttcaagtccttggtacaaagtcctctgcccgcacaacaggcattcgcagttttgtaggaaactttatgcgcccttgtcatccatgccctgacacaatcaatcctctgaagccgtagtccacttccttacatttccgatagcgagaagtcctccatcaaaaaacatgagcactcccatgagcatgaagaagagtccgaaagccgtaaggcctactccgatctctaatgacagatgggcataaagagcgtgagtgggctggtcgagcttatcttcccgccaaaaaactagggctcctcgacattcagaattcgtttcggtgagggtagtctaagcgtactttgagtgtcagagagccacatttgcgtgattatggtataggaggaacggtgagggaagagtacagggtgaataggagatctttgtcgggagtgagaaaggatgagagagatcagatgagccggccaagcacacaccctttcaaccggcctctgtgacgtgtttcacacgtattacagaaaaaagttcatcgtggcaaggcgagacgcgaagtgaaaattattcattatgtatacgctgagaagacccttgcgctttggccctactgccgttgctggttcatgttttgcatttggccacctagttgcgcgccctgctgctgttcctatgtggtcaaggacaggaaaaaagcattagcaaaaggggcgaatgcagatgacgcacggtcactgcgacttttgcaagaaaaaggaagttttggctaccattgcaaactctccgctatccaacattgtatacggaaatggatatccctccagtgagaggttgggacccattctaccatcctctccaaaccctgtcaccccactgggccgcctgtcacccatggctgccgactgtcctgggatgggctggaagacttcgtggctctgacggcgatcatgtgcagcgatcccgtagtgtgatttgtgttccttgggcagcgagattcggtattcttcgcgtggcacaatgtcaatcaggaaatcgaaggtgtctgtcttggcaatagctgctgcaatatcgctgcgctgaagtgtccttctcttgttttcctcagcatggatcctattgaggtgccaaaggagcaaagtgaggcacgattgtaaacttgaggggcccaagacattttttatgatccgtctttcccttaccatgctcgcaaagtcagttcggttatgaaaatgtcacagcccttgtcgaaaatcattggtgcgtctgcactaatcatctttgcctaatgtacacccttgcctggtcagaaccctacatcttttgagcatgtttaggtctttgttgtgaaccggttgaaaatcgtgcctccttactttgacatcatcgtcggtcttcatgaccttcttgatacgtgccagaggcaagtggtgaagtttgtaatcctggggtacgttctgaatttcatgcatttgtttcatccagaacgactgaagcagatgcatatgcgcttgttgcattggctggtggtgagccaaggaaggatcatggtgatgctgcagcggtggaggcgggtggctcatggatggcaataccgggaacatgggctggtactgaggctgctgatagaaggcgctgctagaggctggatccatcactgagggatacctgtcaccaatggagttctgacgctgatgctgctggtattgctgctgctgctgctgctgttgctgctgctgctgctgatatcgaggatccatggtacggtaacaagagcgttggtgggcaagtatatcgaatggaattgtggaagctagaaaaggatggttggtgggtaccgagggagtggactgggatcccggacttgtgagacattggcagaaaaaaatagtggtggcgcacgagcgctgagactgcggttctatttttttttatttctccatttctgacaaagactcttggatcgggggaaaccaagtgagcagctccaagtacttggcgctttgatgatgacttatgtcatcctcatcgtcatctccactatgctcgagcccaccgcgagcatctggaacaacatgcaaatatccagggtctgtttcgatgttccagtccggaatcgcgtaatcaaccagactcctgactactggcgctgtcgaggttgtgtctgcattgagttgaactccctcattcatgtacggccctggtagccgctctatcacctttccttgaaagcaaagcaccggccgactctccatttgttcgccctcgccagacagccaacgtgtcccgatttgaaccccatacataaccttctcagcggcgcgattccacatcagttttcgacactcgttcgccttggtatcgatcaccactaatgccataggccacaatgacttggcataaggaaggagcgcctgctttgtaaactctgaggagacggcaaggatggccattgttggctgcgattcgtacgagagcgagccctggagttccctgacaaatttaggaccgatcttggagttcatcttcttgcactgtacaatcactttgaggtggcgaaccatatcccctggcatcggagatgcactcagaggcaaaaaccaagttccacgtagatccacaccataatcgttatttcctgcagatcgctgcgtgtagatgccaagacagtttctcaaaatctcctgggtctgatactcgaaaagcgttcctcgataaatggtgctgtccgtgttatggtcgaggtcctcaaagctcttaagatcactgtgcgatccacctgcactagggctgttgcctacatttgactttcgagctgggaagtctcgattcacatacggcatggacgagtgaatgtcgttgggaaacggcgctggctcgagctcccgagaatatgtgtgcctgcctccggttgcctgaccttggtatgtcatgagaatcgaccggggccttgccagaggtgtggtcaagtttctttcgtcgccggctggtgcccccattggaggggctgtggaagttgactctttgctagcctttttggatcgtgtccttggtcttcctttgtttgcttccttgagtgtttctgggggaatgctcaattggagcaggtctgatgacgatgctggctgaagttggtcgagtggttctgggtgctgagcggtagaggaggttgttagagattcatcgctaacaaggatagctgacgatgctgacgagcggaagcggacctggggctgcaggcagcaacaatgcacccacgtcggtcgcctcctagctagagctgttgccaatgttctgacagccgaggtgttcattctctacttccgttgttgctgagatggttgttggttgcctgcaaaatggattcgagtaggacgcgaggactcaggactcaggactggagacggaggactcgggagtagtggcttgtacaactcgatgtgagggccgaaaacgctgaacaggaacagcgtgcgacgcgcgcgcgcgcaagaggagcgcctgtccgtgatacctctttttctgcaaccacggcctacagaacatgatgcactcagaaccctgtctgttgctgtacatccctcaaagcgatcgcaactcttagatgaccttcatatcaaaaatttcagaactttgagcaaccttgaagacctgtcctctgcgcgccctgttcatctcactgagcttgttcgtgtgcttcagccgatccatgttcggactggctaaaaaaaagcccgagagcacaaaatttgcacatgcgatttctgcaccgtcctcgccctttacttcacgccacgcgcacacccgtttcccatcctcagtcccctgtcccttctttctcatcactcacgctgagcaagcaccacagagtaccagaagctctccatactacatatggcgtcgaataaggcgcaagatcagcatccgctggtgagtcttcatcaacaaaacatccacgaccaggaatcgggacgacgcgttgttggggctcattctgaggagatgtcctcgtttgtgggacaaagtcaaccttccgacaaccatagccaatccacctctggttatgtccacaagaagaaggtccaggaccgaagcaccaatccctcactgtggaacaccaaggagttttacttttattactttgtcttcatcacatgcatcccttacatgttcaagacggctcatgacgccagctcaggtgagttggacgcaacaagacttggcgtatggcaaacagtgatcaatgctgatgaacgcacctttgctggcttagaatccaacccaaactatgacaagttcaaggacctgctttcggatggttggtttggtttcaaagtggtaggcaaccaatctcgttgtgtgaggggcgtacgcttgtaagaatggtgtttatcgcgtcaaggacactcctctaacgctgcgtgaaattgaactcacaggacaacagcgatgaacagttcgccaactttcgcaacaacctgcccatcctcacgttcgtggcatgcgtttacctactactcagccatgcctaccgactgtactttgtgcctgtgacgcctttgaagtctcctctgcaaccattgtaccgcgcgtatttcttcttggcctttgcggcggtttatctctactttatgtatggcagtgggattatcaaaattggcgctatcgtctcggccaactatgcgatcgcaaaactgggaggagcctcacggtggatgcctgcactcacttggatcttcaacctcaccatcttgttcttgaacgagagctatcgaggctacagctttgcggctctacatgactcgttggcttggctggtaagtcggcgtcgtttttattcagctgctcgattgatcacctttgggccttagagacatcataacattgcacacccatcttgacgcagcagctcttcactttaggacgaacactcgggcatgaatgctcgctgggacgtcaacttcaactttacgatgctccggcttgtctctttcaaccttgactactactggtcacttagacagggacttgggagcctgcctgtaagtgatgaccaagtttaataagccaagtcaatagccatggacagctaaagatctaactgtccttaatctcttcgtctcttacagaaggaggataaggaccgagcgcgtctgaccgacaaggagcgtgccagcgtgccagcgtttgccgaggactacaactttatctattacctcgcctttacactgtacgcgccgctttatgtcgcaggacccatcatgacattcaatgactttgtatctcaggtacggtgcagcctcctcatttgattaattaggcttgagattgactgggcgacctgactgttctactaagcgaccatgttggcatgtcctttctagctgcgataccctaagactattgcaggaaagacgctgggcatgtggatcggccggctgatattttgcctcctgacaatggagttcactatgcactatatgcatatggtggcgatcagcaagcgtcaagcatgggagaacgatccggttttgcagatctgcatgattggactgttcaatctcattctgatctggctcaagttaatgatcatttggcgcttcttccgtctctgggcattactggatgggattgaggcgccagagaacatgatccgatgtgtgacgaacaattactctgctctcggattctggcgcagctggcacaagagctataatctctgggtgctccgatacatctatattccgctgggaggcacgcgctacgccatctacaacatttgggtagtttttacgttcgtcgcaatctggcacgatatccagctgaagctcttggcctggggatggctcatctcattgttcatcctgcccgagatcattgccagcaagatcttttcaaagaaaaaggtaaggtgtcaacgagtgtgtaccacaatattggctggatttgggtgttcataagatggaggcttcctatggctgttgacgcgtattgtacctttctgatgatctagtggggaaactggcgccactatcgccatctgtgcgccgttggtgcagtaggcaacatcttgttgatgatgattgcaaatctggtcggattctgcataggactcgacggtgtgaagttgatgttgtacgatctcttctcgagtgtccaagggtgggtgaccatgtgctgctgcttttgtgccatgtttgtctgtgcacaaatgcaatttgaggtgcgcgaggccgagaagaggcgtggcatttttttaaactgctgaagcagcaataaagacttgtctataaactggcgatataagattgatatgatgatggccatggagtgcaaggcccacaacacggtcgagcggagtgaaggctgcagctgaccgtaacgcgtgtctgtgtagcgcttatcccaagctttcatcagctttcatccggtcttgagcagtcttgagcaaacaggctgagcaggggtgcgtaggattgacaagggaggagtgagaatgtgaccagggcgatgggcgagagaacaacaaaggttgcaaggttgcgcgcggtgggtgcgctcctccccaccccctttttttttattctactactgaaccccatgagcatcacactgcacacccacgcatcatccacacgcgcctgtgcatgcgtctgctcgcatgcgtccgagtctgagagtaataattgtcccatgcctgagaggtcctggcctggccactcacacacgccgagatacgctcgctctaggtgagccgctgaggctgaccaatgttccctcgcgccagaggtcaacgctgcccctgcccctgttcttctgtgtccaagcaagcccagccagccgagggaagatgcggtacatcagagtgaataccagtgaagtaaacccttttttttttttttttgactattttgccatgttcccctccctttttttttttttgtctttgcttctttccttcgtccttttgctcttctgttcgtctattccacacgcacccttctctcctgctctttgtcgccgccctctgcagcatatcatcagtcctcccgtcgtctgctccatcgtcatcaccctcctcgtcctggcccttcctcctccacttctttcccagccttccatccgattcgcgaacctctcacgccccacacatcctcgcctgccccaagctcgcccctgacacttctcatccctatctttgtcgctgcagggaaccttatttatacattccaacctcagctggatacaccctggccacaccggccctcaaagaacctcagcaaccctcagcgtttttatctgcttggtcgcctcaacgtagcccagcctgaccagagccatccagagcaggcacagacgcggacgacacagcatacagcagcaagagcatcgagagtcgtagaagtgccatccgttacatacgatacagcaccaagagtactcgagtcatgggagaaaacaacgctcaagagcacaaagcgaatggtgcagcgacagcgacagcgggctctgaggcaggagcagccaaggtcatgttgcctgcaaagctgatgcccatatccaccaaggccacaatcacgacaaccacgacaaccacagcagcccagggcgagactcgatcccctggagcggtatcagcaacaacatcgcccatctcgctcaagccgtcctccccaacaatagcgcaaacatacatgcaacccctgtcgcctaccatcatcacaacaccgcccacgatacttgctcacagagacgacgcgatctctacgaggggcagggtaggtgcgcttgggaaggtctcggcgtcgtctgcaactgcaacgcttcataaaaaggactctggcacgtacatggcttcttcatcaacccagattacagctgtcagcagcgaaagtgtgaacggagttcaagcaaatctctcgaacgggtctacaacgggggcaaccgtggcctcccgcagggcgtctcagccagatgcagcagctctgatgtcgcctgcaggaagagttttgagtcgccctctatcgacatcgaagctctcgtcaactccactcaccgccccacatattctcccaaaccaacgctacgctgggttcaaccttgctgcactgggccagctttcaccaacggcatcaactatgaccatatcaagggcggacgtgctggcacacacaggatcgagcggctcctctcataattcatactttggcacggtgtctggagcgtctgggactcgaagtttcggcgagagtatggctccagggagcggtatccatccagagggggtggcgcttccgtctggcaccaagactatgagtggatcggatgccatctcgctgctggacatggaggatagcgatctagtcatgattgacagtaatgggaacagtagtaacagtggcgtcactggaactgcgatcgttggcgaaacaatagcctcggcctccgcaatcgtcagcaaccatgcctcaggaaatcaaacctactttggcaaccatagcggcagcggaacgctcacatcatccgcatcctctgcgttactggaggctagtgctaccggtgggtcgagccatcaccatccaggtgcttctgtcgcggcgtctcatctttcgccacgatcatctcttccctctttgacctctcaggcgaaaaaagacgccatccaacgtgccgccatgattgcagccatacagcaaaatggtggtgcgaagatattatcagcccaccgagtcggcaggcggcaggatcgtcctaatcgagggattcggttcggagagtttcatcggatatgcgaaatcgaatatgggtttaagcagggcaaggtgagttacctctaagttatggccatgttggatctgattgagatcctcaagtggcttcattgacaaatatcgactctattaaaccccgctgaatagccgttgattgcgaatgggaggaccttaatacattctacaagggtttcgagattggacggcgacatcaagcgggaggagatggtgagcgatgagcgaaaaaaaaacctccccttgctcgcattgccttcatgcttagtttgttccgctcgctgaccattatctaccgcccggcagctgtatctcttttctgatgtccttgtcacaggtacggagatcacgacggccacctccatcgcagcgcccttgtcatctgcaaagggcgcaccggaagacatcgtggacgttcaaggagctcccatcggagacaccgcagttgagaacccgtacgcaggtcatctggaaaaccaaaacatctctaggctgacgcaggtgcaggcagatgtcgtggaaggcgatggtacgtccatgtttgctggtagtcaatcatcgtcgcactgtcgtggatacttccactcatctctgttatcaatgtcgtgtccctatgaatagagcggcctctcctgaaactcacagcgcctcaagtatcttcgctcctgctctttaagtccaccgcatgccgcgacagtttcctagctctgctgagtgagacgattgtagcgcataagcaccaccttctcttccagtccaagtatcttgcggacctcaaaaagtttaaacggcactcagccttctcgttcgacacatcattcctcaagacctggggtatccccgggggccttaacttgggctctatcagatccgctggtggcaatggtggcggaggaagtggccatggcgctattggtcctggaacgttcacagcgtcacccgtcacctcgcccggcggtggcgcctttgacccctatcagtatcagcaacacctgaatcgccctcagtccatggcagggagtttgttcaactttgcgctccatggtggtggcgccttttcttcgttcacatcgtcggcagatcagaacagcaaggagagctcgtatgcaacactacggggtgcgaatgcagcgcaggccttacaatatcaccatcatcatcagcagatgttacagcaacagcttcagaaccgtttgtccatgtcctcaaccgcatccatctctggagggaaagcaagcgacagaaactcctcgagttccgcattcgatgcgctgtggttcatgaagggtggcgagactttcagacagccccgacggaccgcagctgaagcggtctcggccccctctctcgaggacgaggaactgaacatcgacggagaccccgcgggtcacttgcctacagctgggtcagccgcctcttcgatccattcttcctcttcagctacaaatttaacgtcggccagcaataacccaagcaacgggcatagctcgaaccgattttcttcgtcctcattctcgctcttgccttcgtcaaccgcctcgaatcatcaaaatattggaacgttgcgtaatggcgctggctgggtccgagacgaagatgcttcagtatgcatggtctgttcgacaaccaagtttggtgtgctggtccgaaagcaccactgccggctctgtggtcgggttatctgctggaagtgctgtcagatgaaggacgctgtggttctgaacaccacccatgatccgacggaagctgcgccacaagcccaggaacagcaactgcgaagacccattcgcgtgtgtttggactgtattgagcaggatgcttcacaggacactgctccacagcagcagccaaactcgccccacgcatcttccttcccactgcagggtgtgtttggtaagctaatgaactcgaccgttagtattcctcaccttgtgacctcgcctacgaatgctacaggaagcacgttcacgacgtcccagccccacgcccagacccatccacaaatcccgtttcctctatctcagccatccacactctatcctcgcggaatgagctatacccgaggcggaagcgcctatcctcatcaccaccgagcgtccctttacaggattgatgttgagcgtgttggtgaggaggacgaggaggacgaggacgaggtagaaacaggaccccgggacgagaaatccgcggaacagaaaggcgacaatgcgacctctacgttttcagagagtgtcagcgactctgcagagggtcgcaaggccgacgcatcgcaccaggagcattccatggatgtgcctgattcaccaccgtcctcaacgtcctccctgagcaagatcatcaaatcgaaccatgggacactccgtctcaaagatctcgatcctgccgatatcaacgaggacgagatcaattctcagattctcactctagagtccgaggtcgagagtcttttgatccagaatgcggcggccgcagcggcttctcccttgctgttcacaggatccatcggcagcagccacagtaacgttagtgctggtaggacacgggtcatgcgcggcgtgcccaaagaactcctccaggcaggtgcactttttgaaaacgaggagcacgaaggagatgatgaagaggaagagcagaccgtggaggaactactagctcaacaggagaatctgcatcgcatgctttcataaatcaagataaaaggttgcataaatatagatgatggagatgttttttttatataatgttggtcaccgcgccggagtttgagggttgttactctgagatgtccttgctcgtcgcgtttacttgcccttgcccttcttggtcagccactgaagggtgatgtcgatgttgacttggttcttggccgagatggagtagcaagaaacctcacgacttgcaatttgcttcaagttcctgtatagacacgtaaaaagcgcagcagaaacaacgagtccttagttagtcatggtttgacagggcaaagttgcgggccattgacgacgaaaacgagagcctgttcatccttacatgacttcaataatctgatcgacggtgagtgcccccggcaggtcgtttttgttgcccaggacaaggacagggatgctggccaactgtggtttatccaaaaggtttcgaagttctgtcctagcagcatccaacttatcgtggtccgctgcgtcaatgacgaatctagatggaaaattgcagctcaacattaatcagacatgatgccatagaagaacacgtcctttccacaaatacaggtcttgagagaccgggcttacactatcgcgttcacgcctctgcagtatcgttcccacatactcctgaaccttggctgtcctccaatatcccacagcttcattgtaacgttgccctttgagactttgcgcatattaaaaccgactgttgggatcatgtcctcttggaactgtccagactacatttgggtgaaggtggcaaaaaaagcacaaaaaaaaactttgtcagttggttcgttcatgccctgaatcagtataaaagacacgagcacgacgtccctcgcacccccaaaagtaatggcaggagaaaataagtgtcaacctcaagcagggccacgttgaaataggggtaaaatgatggttgctggggacactgtggttgcgcgcgtcatgatcacgagcgtcctcctcctccccctagtgtgctgtggtcatctgtgaaccgtgatcacaccgctctccgccaggggatgaagtcctgtttttctatccaacggatcgaggttcatccctggaaaacgtcaacaggtcggggtcaccaagcaatctccccttcctgaactggtgcgtctgaagaatcccaaaggcctgtttttcgttttgtttgtgctcgtttgttcctgtgagcaaatatacaactttttggtattcccttggtgtgaacactttacaacactccacggactgattcagccttcccccgcagagtagtgaagaagttggacgttggcggacgatacgcaagcacgcaagctgtgacgggctgctgacttacagcgatgacatttacgagggtggtcttgccactgttttgcaatccgaccagggtcaactccatctcggtctaagtgacagtgttggaagcagcaggtgcatcagtgacagaacagttagctgattactgcgtgtatgcctagtggacgctcgtatcctttatccaatgctggaggagtaggacgaggtcgcaaagaaggtgggatggcgcgcaagtaccttgaaaaaaaggctccggagccagtcgagcagcgcctgaataagggacgccatgttgaaatgcacttctcttcttgttttataatatctgttctgccctgtgtgtctcttttgctcgaggtggtcaagaggcctggcgtgcgagtgaatgcgtctctgctgcaagcgatggctgtcggtgtgaagtgatggtgaatgttgagtggaggatggagtggtggggaaacgaaaaggaaaaaaaaaaatcttttcgtcctggctttggcacacgcgttgccacgggtctcgccgtttttttttgagtctccgtcgagcaactctcatcgcgcaccaagggatcgagtgggacatgagccttgcctcccctgcaaagatggagccatccagtatcagcgcagcgggacgtgcatggttcgatctttgagaggtgttgcaccgaagtcccagcaactacagccaagtggtccgttccttggtccaaggtacggtgtgggggaccaaaggaagcagggctcctccacagaactagtgcctttgccagctgaaaatgcctggtccagaaactcgttttggctgcccacacatggtgcgattctggggtctctgggtcaccttccacacattagaggcccagctggtcggtaaccttaaagtgcgcaggcgccacggtcgctctatacctcggtctcgccctgctggtccgcgcggagatgcaatctcttgatatcactgtatacaatttattgatgtgagggccaagcctagccctcgcgattacgccaagtagaatgtgtgcgggaatcgaggtcgtcataacaggacagggttacttgctgctactcttgaacagcttgcttgagctcttgtgcagggtgctgttgcgtgagcccgccatcagctcatcgacttccctctgctccgcctccactaaagctctgtagtgctccagttcagccaacatctcagccttcttggcctgcagcctctcctcgcgttctcgtaatgctatttccttctcctgcaccttgctgatgaacttttgacgaacctcttcttccctgcgttccatctcttgcttgttgagctgctttgtgccttcaatctcggtttcatagtgatcgtcgcactccagaatggaggcaggccgaccggctgagcgcagtgcgttcgcacgatgttggtgatagtgaacctcatgggtactctccacaagatcatgcagacatgtcgccaatagcagctccctcaagtatacaaagtccgagtgctcagcgttttccactaaagttcacaacaaaaagtaaagcgtacttgtaagctagccgcctaaacgatgagggttgttacttgtcagcacagctcagcacaatgtcatttttaccttcaaccacaccccagcgataagaacgacagcgcactctgcgatttcccacaagcgcaaagctttcacttccaatgaccgagaacggaatatgtctctgttttggaatcgtgaagtgggtagattgtgaatgcttcatacgataacgccttgatgattagtgcatttttttcgtaggtctcgttaccaggagctcctcggcaccatccacctcgtcagggtacgaagatgggaatgtcctgatgcgatgttcctccagatcacgtaacaaaacgttcttgaacaatgatcgctcctcggcagtcatcatgtcggctttagcgatgagagggatgacattcaccttgcgagataatgtttttaaggctttgacatcgagctctttaagtctacatgccaacatcaagaacttgtggtgagcatagaaagtcgctgttgctttttttttttcttgtggagtaatcgtcctcgtccaaattctcacttcatacgacttacccatggccattgggtgcaaggaaatagagtacagcatggatcctggtatcgggtatagccttgcgaaatcctggatggcgctctgcagtcatatactcctcgtactgctgatcaatatattcgatgatgggatccaaactatagcggataccacgagaaaatgagtgagcgtgctgagtgaagggagacactctagaccgtgcatccagagcactcacagaactcctgggtgatatggtacgaatgaagcggctgtagagtgtgcttacttgtgttccctgtttagttcatcgccaaagccaggagtgtcgacgatacacaagttcaaggatacattatcctcaaccaactctaatatacattggccgaaggcgacaaggagctttccgtgcattagtaaacggccaataatgacgcgcaaaaaaaaaaaagtgctctcaggcgcatgaggcctgtccatcctctcgcgatggataattggagcaagcatggttaccgtagaaagttggttgaatctggactgtctgagtagagtggattttctttggaagaatctcatccttgagatccgtattgaacagcgtattcatgaatgtcgtctttcctaggccgctttcacctacaagcaagcgggtgatgttgttagtacggtgcagaaatcacaaaaaaaaaaaaaaagacaagggggcgagacaaacaacgagttggtgcgtacccacgaccatgagattcagtccgaaggcagcgcgtttgactttggtatgtcgctgtccgggcagtgcctcaagaccaagaggagctgacagctccaacggcctggacagtgcgtgcttccatggacccggatctggaaactggccactgtattgttttttgtgtttgatatgtagaattggacaatgatgcgaggtggagaggtgaatatgtattgtcatcggcaagatcacatttattgcgaatatattaggcccgcgcaactgccgattgccagggacctagaaggggaaccataaaggcgtgcaattttttttgacattacttgtgttgatgcgcgaattcctgtggtacatgaggggatgcgaagaggaccaaccaaggttaatacgcgtgagcacgttctgcgccaggtatggccttcatgcaggatgcaaaggctgactacaccggaatggggtccgtacaagaggcattgtgatctgaatggaatctgaatctgtaagagggtttgctttggcctggatgggaatttgccgaaagagtgatggagaaagggagaagcggatgcaagtgagccgaaagcaggaagcaaagttgggcgaagggcaaggtcacgcacgactttgtggagcacggagtgtgcaaaggcgggcagacaggactggaagagtgaataaagtgtgagggagagagagagagcgagagaacgagcgagtgacaacaacaactaggtcctcgaaggaggagaccgagtgcactgcgagtaagtgggagaagggaggcaaagaggggacgcgaacgagaaaagggacgcggacacagccagagcgcaccgtccagatgcgcgtctgcatagagttgagggacacgaacgagtgcacccatcgacatgggcttaggtggccctggccgaactgggccgttattggctgggagcagttttaccccgccccgcctggactgggcacagtcgatttgcctgttgtctcgtgcgcggactgggtgcacggaatatcgcacctgcacaaacacacagacggacacggacacatcgtacgcctcaggatggcagggagatgcgtgaagtggtgtcgcagcagggcattccgcatacgtgtatccaggccaatgtaagtcccatacgcccgaacgcccaatgcacgctttgccttgccccagcaaaaaaaaaaaaaaaagggagctgcagaacggagaatggacgattattattatcgcagtcgagacacgaagggggatcgtgacctccactcaatcaccgtgctcgcacttcgcaaagcacacaagccgaacagcccatccatcatcccatcaccgcacatgcggcactcgcttagagcgacgcagagctgtttagacgcattctccaccgctataaaagtcgcatttcgcgatttctttttacatcttctctcttctttttcctctttttcctctttttccttttcccttttcccttttgcgactcgccccactccactgccccataacagcgtgcacccctccttcccaatcaccaagaacggccatcaagtgaatcaagtcaagagtagccatgtcggaatccgtgctctcccaaatcctgatctccctcgcggaccttaaggcaagccagcagcttcttgctgacaaggtatgttgtctacctgagcctcgcagcggacgtttgctcttctgcgaaggcattttcgacggtctaaccgctgctgcgccattactctgctgttaggtcgacaagattcaggctgacactgtcttgtccaaggacgacctcttgcctcacaaagttgcccattaccacaatagtcctggtatgttattgtgtgcgaatgattgcttctcattgttgcggaaaagaataaaggcagagaagccctctgtgctcatgcctgtcggcatgctagacggctagctagccacattgtctgccttctgaaggaaagaattgcgtggacctagtttttcttctttgtgtgtgtgcgcgcatacccctcatattccgctatattatgcacatcacccctccccttttgctattctctctgatctcgcatccccttgtcaaagaggatggtgttatgtactgcacaacgcaagaccaactaaactgagcgtcatgctgacgatcgagggtcataccttggggcaggaacaaacaaagggataaatgctgtatcacacaaacatccctattctgtgtgcgctgtacagctgtttgcactatctaaccacttcatcgcggttttctcacacacttttctgttttcccaccgtctctctcattctttgtgtgcgataggccattcggactctgatgtcgatacgatcgtatcgccctgctttgaagctgagcgtgctggcatctacaccgaaaagcccgtcatcaccagtaaggacagaaagagattctaaaaaaccaaggtgtgcatttaccgcttttgctgacctacatttcatattttttttattaccgcgattgattctttttcttcgtcgcagcttatgagggacagaaaggagtccgtccttccaagatgaactggggtgaggccgatcccaaggcccgtggccctgtggttgtttctcgtctgcccaactcgatcaatgtccggtaagacccccttgtgcacacacctgtaggaaaaaatgaaacccgtactgagggtgtcaggcgccatcttgcacccgtggacaatgtgagccctgactcttttgtacgtcgaattcattgcgatagaaatgccattggtgcttatggaggcccttattccatctaccgagctcttgctattgccatgggcgatttaccagccgacgtaagtgcgcctttaccgtgcttgtgcgggccgacgactgatattcatccttttctaacccttctcggtctccggttgctttattgtatgatacattagcataagcccaactttgataacacacagcctcccatcacgatcaagcagcagccccaatgggccgatgcatccaagattgtgtcgatggacccatttggccacctcactaaccactactacaaaagcgagatcgaaaagggcctggatgtccgtcctaccattgccattactcgcgcacacatgatcgtccccgaggttcaggctgcactcagcagtggagagatgaaggtcgacggcaaggtcatcgtcaacgaatcgggtgaactcaatgtccataaggcagccgtggatcctgtctggtaccttcccggtgtcgctgagcgcctgaaggtcgatgaggaccatttgcgtcgctcgttattgtaagtgcacctgaagtgtaattctccttgacgataagattggtggaaaaagtgtgggatggcgttttacgatccaatgcttactcctctatgctttttttttgacccccctcccccttgtgtgatttttgtaatcatacagcgagaatacaggtggaatgtaccctgagctgatcacccgacccgatctgaaggtcttcctccctcctatcggtggcctgacagtctatatctttggcaaccatgagctgctctcggatcccaatacgcgcctgactgttcgtgtacatgacgagtgcaatggatcggatgtctttggctcagacatttgcacatgccgtccttacctcgtgtacggtatgctcgaatccatcaaggaggcgcagaatggcggcgttggtctgatcatctactgtaagtttagttcaagacgttcttcatcgtttgacggcatgacgtgcatagcgcggccttttaaaattctgaccaccctcgcccttctttttctctagtccgcaaggagggacgtgccctgggcgaggtcacaaagtacttggtttacaatgcccgcaagagagagggagattctgcgtccaagtactttcagcgaacccaggatgttgctggtgtgaaggacatgcgattccaggcactgatgcccgatgtgttccactggcttggagtaaccaagattgaccgattcatgtccatgtccaacatgaagcacgacgcgctcatcgaagcgggcatcaaggtatgtgtgattctccgtgatgtgtgctttattttgtcatatacgcattagtgttcgcttgctcatgcatgtaccacgtgcccaccccttttgtcacattcttccagattctcgagcgctgccccatccccgatgacttgatccctccagattcaaaggtcgagatggatgccaagattgctgccggctacttcacgactgggcgaatcccgcgcgaggaggagctgtgtcacactgttggacgtggttgggatgagtttcaacactaagggtcaagtaggagaggcaatacatgggtaatgaagttggcgctaccggagcacattgagaataagcgtcatggacacagtcagtggaaagggggccgagagaaggaggtgggaatccatgttttggtgcggggtgagggagcagtgaaggacgagcaagcgacatagacatgtagcgaaagcgaatgtattatacactttaagcaaaattgaacaacagaaaagaaaggatgtgccgaacgaagacgccggatattggtgcgtcttgatgctcaccctgtccctctgacacggaacagtgcatgcaagcatggcccttggttactcagccttctcctcaatcgcttgcatctcctacaacccctcgcagacttcctgcttggtctgttttgaccatgcttctctcttacccactcacaacgcccttcatgtttgccctccacctctttttcagctccaagggaaaaccccaattccacagtgcgtctctttctcttgtttgccttagcttgtccaatcttgcccacacaacccagttgagatcaacctctgcctcccattatagctggacgcatacattcttttcactcccctcctttcccttcaggtacctccatcagaactttaatacctcacgcccaccttgatcatgtccgatccagtgttgagccattcccttgagcagcaactatacatggagagacagagtgacctacaagacaacagcaccgtcaccgacgacaccgttggtcttccaccagtaacttacatggccaacgtgatcgcaaaccagctgttggagcgagggagagtcatgttcggcagacgatctgacgccaactgcattctcaaagttggtgaaaagaaatattacgtgcacgtccagatgctcgcggtaagcatacatcctcctccttgcctcagccagcccttgaccgatttctaccgcctggtacatgccatggcatttcagaataacgtttggttaaacagtggatcaagcgaagaaaaaagaccccttcccttgggatctggaacgaaagtcctcggccttcaccttcctgttccttttggcactacgttgagcacatgcacactacgcaatagacaaagggacagtacgtttgttaaaagtataagtgaaaatggtcaaacaggaaaaagagaccccaccccttcgcggcttacatcttacattgcagcatcaaatagctgggatgcagagcgttgttgtgcataagggacggcgagaggcctgcgaagggggggggggggtcctctttttctctgcggttccttatatgtggttgctcgaggggacgaacgggacgaatgcggacagcaaataggggcagcccgaccgacctgcaaaaccatcatattggtttctcctccctatcatctcgttcaagaatgccattctatccgtccttttctctgtttgggccaatgcgattgtgatattttggaaggcccttggccacaaatctcttagtttccctccgcctgataaaggcattcattgtacggggggggggggggtgagggcgtggaaatgcatgggttcttgtggccgtgcatcaccacagatattttctcctgacaaaaccattaacctttagcatcgccctttcttctggctatggacgtccatgacccctgcaggcacgatcacccaccttcagacgcatctttgacgacatgatagctaatgacgcctggggtcgattctccgactctgaaggttcgagcgaagacaatctggaagaacttgacccaagtggcgatgaaatggaagcatgcgacgatggtaaagggacatccgcaagtggccccgacccgtcacttgagccatgcgcaatatatatcgttctttaagcagctcaccatgctcacactatgaggtttgtttgttgtacaatgatagcacgggcgtatgagcagtggcgtgtagaccatcgcgatatcgaagacatgaatgccaagcttcatcgactgggtctcaaaggttctttactattcaacaaagatgacgacaaaggagagcatggcgacacctctcaggacagcgacgacacagatggctacttacctgaactttctgtggactttcgggatcctgaaggaagctatttcgaagagctgttgcgatgggtaaaaaaaacctcccttcccagagcagcccaccctatcgccccatacccttggtttcggtgtaagcacgtactaatcgagagctaccaccaaaacgcgtcaaaccttcgccccgttaggtctataccggcgaagacgaacgctggctatgcttcttcacgcccgaaaactacaggtctattctggagaacatcctccgcctcaacattgtcaataagcaagttcttgacatctgtctcgcgtatgaggcacgcacatctcccgatcagaaactccgaggcgtagccatcgacttgctctcttctcattcacatatggatctggacgaggccgacttgacgtgacgcttcacacttgcctttcacgtctgtcaagtaatctatgataatggccaaataaactaaacccttgaggaagcatgttacgcgccttctatacacaccaagggtggcatttttagccctccatgcaccctattgcaggtgctgcgatcgtgtccctgtgccgaaggaaggggacagtgtgacaccaatgcatcctcgtcctaaagcagccatgaaagaaagattgcaaaaccactttagtacgtacaattgcgccatacactcactgtaacgaatatatatacagtaatggcacgcctgaccgcactctgctcgcgcgcataattaatacgcagcggtacagagaacaaaagtctgcgggatgcgtttcgtttcacaatgcgaatgaacggcaaggacaaattgcgcatgacgacgacgtattttagttaggaaaggcctatgataagggctctagaactcgagacgacgtctacggttgattccctgcaaaacaatggccactctgcgtttgatggacctctcaaccgagcagcttctcggttccggtttgcacgaccatcctctgcagatattccatcttgaggttgttgtctttatcaatgcgttttgccaaatcgagccacgaggcaacacccagatcctccagtccgtagtcctccctcgttcgatactcaacctcgtattcgcaaggttttatcggctccatgttcgcacgcgtgaggttggcccagtattgtgtgtatgccagcggaaatccaaaggcacccgaaggcacagcaggagggtgggctcgtggtttccggtgcctgtgcctcggcttatgtttaccatgatgcttcttcctcctttcgaacgaaacctcaggttcgatgtcgccattgagtaatgctgtgaaatattcctcgagttcctgctgtcttattctgccgtcctcgtcctcgtcctcgccatcgtcttggccatcatcctcgccaacgtccgccgtggcgataaaacagcttgcaggtcgatacgagtctgtcgctgcagtgccatcgccgatggcagaggattttgcaaattggtatgtaaagacacgaaaggtcggctgatacgttggcacaacggatgccgagaccaatactacagcatagttgctcaacttcactttcttgggtatatcgttgtactgattccataggtcctccagataggaagtcaaccctaacgcatgaaatcggtcgtagtcctcctcgcccacggcactcagggcagcagcatcctcctcctcctcttcacggacctcatcctcttctgcccacaaatcatgtttgactttgcggtcggacaggaggaaaaagtggtcgatattggcgtggccgtacaagtgccctacgatcacgtccgcgtactcgagcgacagtcgggtgtatctagcgtagcacgtgggcgtatatgactttctgtccggaggcacatgtcccgccaaataagcgaccatcttccgcttccgtaacgatcccagctctgtctccagccattccatgtgctctgttccagcttcgtcgcgtttctggcacccgtctaccgccgtgttgtggatgtaaaagtagagcgtgtttagactcaatacactgatcttatccgggacgacctcagacgcgtagtatccaccacggcggaacgtatgaagctcgctctcgggaatgaagtctgaccaaatttcggcgtagtgtttcagaatcgaatttggaccaggctcaatgatgttgtgagggtagatatcgttgttgccgatcgcaggaacaatgggaagtcgatcgcctgtgaagtcaggagggaaggttgccaggaatttctgggtgatggccttgttcattttataaatttgttcctgagtacgaggttgtgtgttgtccgagtcgtgtctacagtgctaaagagcattgttagtccatgtgcttactgccaagactcgttgctgccattaccagttgtgatgaacatcacccaccttgcattatcgcccgtccagactacaaagtcgatggtacccaccaggttcttgtcaaaccagtcaaaagtcgcgttcactagcgtaaatggactgtcgcaaatcgaatgcggggctccatagtatccgccagccatgtcctcctcgtcgtccaggaagcgctttggataggccgacccatcgtccgatcctgactgcatcctgtggcaggcggtggagatagccgccccagcgtggtagtgatcgtcgtagtggatgtccgttacatgaaggaactggcctttgagtcgaagtgaggagtatgcagaggctacagagagcacacagagagagcacaggagacaggcgaccgagaagctgtggtaccacggccggttggcagggtgaggcgagaagcaacgagtcactccctgcagagtgagcatcgcgtcaatgagcgttatgcgggcgtggataacgataggaggcgcaatgcgcaaccgtgggatgggcagatggtgcaagtggagaaggtggaaagagaagaagacggaattgagaatgcagtgggggcaggttggacacggaaaagacagaagaaaaaagtgacagaagaactgaagcccagggacaggcggaacacggcgcagcgcgtgtcccttcggaccgtgtgagcacttgagcccatgttccaaaggcccgaccgcgctccgcaggcagcatgaacgtgatgcacttgctcactcctgatcctccaagcaggcaatgcaggtgagagctggaggcgcgccgccaacggcttctttcgttgggcgtgggaaaaggatttgttacaagaaaggctgcgtcatagtgttgctaacgaccgtcgccgtacgtttttattgcgctctgtcataaatgtcatactaaaactgtcatcgctattgtcgaatgggttcaatacctgcttcgtcgaaatgccgcgtccacaggtcgtttggatttcatacacacctcaagagcgaggtacgaggtcgaaagtgcgttaccccaatccaattctaaaagtcctggcagcttcctgcccgtcttgcaatgctgcaacaagccaccccctctcgcaacgttcctgcttgtgtgatcaacctcaagtccctccttcacacaggatccgcgcagtatttaaatcatggcatcagcaggaactggttcatcgccagaaaagaacacagggttcatggcagggtacatgtcagacctcaaacagacacaggacctgacatcattcttgcaacagaaccagccaacgtacaacgcgaccgctccgtccgctccggtcacgctagcaggcatcaaagtgtcgtctgcgagcaaagataccactgccagctctggatcaacccaagaaaactcaaacacagacagcacatcgtcctcgtcgtattcctcatcgtcgacttcatcatcaacgccatcctcgtcctcttcgaccagttcaaacccaaaagcacaaccatcgaacggcaagtccacagagagctcccacgcacctccaaatgcacatgccatctaccagagacacgctactcagggcgcagctatggataactgcgccgatttgaacatggaattagctgattgtcttttgggaaaggcaggtacttggtgggatcgggcgtcgatgtgtatgaaggccaaggaacgattcgggaaatgctgccgattgaatagggtaaggttctaatctgtggcatgttttgcagctctaatgaacgacgttgcctaacgatcccatctccgtatataggaagcactggagaaaaaaggctatgctcgggagggtaatacgccagagcagaaccaggcgatacaggattatgcggacgattatactcagaaagccatgaaagatgacaaagaatgaaactctacaaggagtgttcacctgtcaataacgtagacgatgtgctggatgcctcgaggacaacatatttctttaagcggtgaccccatttcacatacaccagcttttaaaagcctgaaaagttccggaataaacaccagagcgatctcccaggaaaggggaatatggggcaaccacatttgaacaaactccactcgatgctgttgacccgtagaccacatatgacccaggactgcgtaaattcctcagacggctccaaacactgcacgcgataatcaaccgtgctactctgcctactgaggtggcagtatactgaccagagatctccacgcgagggttaacgccacattgagccaccttccttgttggctcgagccagcactaccagagggaaaagagaaaaaagagaaaagagagaaatagtcggtctcgaggttgttagtcggctgtctagggctggctgcgtgaagaagagaatacaggcatacaggcgacgatccacaagacaaaaacgcaccttttatgttggctcgagcccgtgctagcatagaaaaagagcaaaagaaacggcctcgcggtcgttagtccgctgtgcagggtgctgggatgaaggccattctcattcagaagctgcattgcaaagctcatttaacttactcttttgcctcgagtgtctagcgcagggttgagagtgaaagagagaagaaagacggtatgtaggcgagttagcctccagtttagcgtgttgaagggaagcctattgggcaaagtcaaccacgcgagaaacaacgcgacataagcgtaccttttctgttggctcgagcccgtgctagcatagaaaaagagcaaaagagacggcctcgcggtcgttagtccgctgtgcagggtgctgggatgagggccattctcattcagaagctgcattgcaaagctcattgcacttactcttttggctcgagtgtctagcgcagggttgagagtgaaagagagaagaaagacggtatgtaggcgagttagcctccagtttggcgatttgaagggaagcctatgtgcaaagtcaaccacgcgagaaacaacgcgacacaagcgtacctttttttgctggctcgagcccgtgcaagcatagaaaaagagcaaaagagacggcctggggtcgttagtccgctgtgcagggtgctgggatgagggccattctcattcagaagctgcattgcaaatctcatttcactcactctcttgcgttgggtctctaggtcagggttgagaatgaaagaaagaagaaagacgacaatagacgactcagtgatcgggtctcacttattgaccttcagcatccagtcatccatgggcacataagcagtacgaacgctttggctcggccacgcgctgcgctttgttcgagggactagggtcagcacggtataggcactcctcacacccaggtgttactaagatttcttctccatatcggaggcgcctgtgttagttccggaaacttgtttgaatgtgcttgatggtgaagttgaatgtagttgaggtcagtggtgaagttattactgtacatcgagtggtggtagctcgatatcgtgttaaggtgtgagtggcagacttgtttgctcgctggtatgcgtcgcgaatatccctttcgttgttgtggaagtagctttgctcacgggaaacaagaacgtgtggtcccatgcgcttacccgagaagtcaaatcggaaatgtcaatgtgctgatgccctgactgtttatgaatgtcggaaatgagattgcatttgcgcttcgcgccttacttttttgtcattcgtgttctctgcagttttgggctcacgtctggcgagcttgagtcttgacaagcttacgagggaaaaaaaagataggtaaagaagcagaaactttgtcggctgtttatgctcgctccagcagcgcacagcatagagagtgtcgacgagcttgagctatgggacgttcttttcggatgaaggctttagaaagggagttccgagttgtcgatgctgacgttgggcgttgctggagaaggcgagtcaacggggacgcgaacagacgaaaggaaacgagggaacaaatggggaggagtggccgcgcgattaataaattcatttgtgaaaccacgtttttggctcgtgcgattctccacggtcgaaatctcaggcctccagtgcagtaggaaaatgcttcaagttgctggaaagcaggtcacatttaaggcacgcattattttgtaatttagcatctcacaaccacccttcaagctcatggaccctgaagacgaaacactttccctcgaagtggaggagacagagcatgttcttacagaatgcagcacccgacctccttcgggaactagcgtgcctcttctgaagtcatacacttacgccacaccattacctaccgcactggagactgatcaggaatgcatccttggggtcgatgaggctggaagagggcctgtcttgggtcctatggtttatggcatttgctactgcccactgtctagaaaggatgaactggctgatttgggctttgccggtacgataaacatcaggttttgttgtagacctcgaatctctagtgctcgtgctgattctgtcaaggctccacacatgaattcgcatagattcaaagacgcttaaggaagacgaacgagacaaccttttggaggttataatgtcgagacccgaccttattgggtggagtgttcgagttctttcgcccatggacatctcaaatagcatgctgagaaagtaagggtggtaggaacgaatatcgaaataaggagcacggcgaccagccgaggaacagttgttaacctcctcctcctctttcttgccacaccatattcatagagagaagtacaatcttaatgcgctggcgcacgacacaactatacagttgatccgggagactcttgcttccggagtgaacctgaaagaggtaatcagagaagcgtttgcaaagaattagctgtttagtctgcgctccagttccctaacgttgccatccataggtctatgtcgacaccgttggacctccagagacatatcagaaaaagctggagaggctctttccttctatcaccacgattgttgtggcaaaaaaggctgattccaaataccccattgtatcggcagcgagtatttgcgccaaagtcacccgcgacgatgtactgagacattggatatttgcagagagcgggatggaggacacatttagtcgacagttcggatcggggtacccctcggaccccaagacggtgtcatggctgaaggctagcatggatccagtttttggatatccaaatattgtccgattcagctgggccacatgcaagacgttactggagacatcgggaaagactgttcgctggtaaggtgttgatggttttgaatgaatgcccttactgccggggagggttctaatcagatcctttttttctatcggacggttactaggcctgatgatgatgagagcaactcacagccgagaatcacggcgctgttcagtcaatccaatgaaggcagtgatgatctggagaagcagcggaagcagtactccatgttcgcctcaaagaacgctcctcggccgagacccatgctcctgcaagatatggcattaagaagtgtagcggaattttgaaacaaatcaaatatcagttctctcttctcgtgctgtctaaatttttcgcttttctccttccttcttcttctctctcaccacaaacccattgccttatacacctggcatgattcccaatgcctcctgatcagaccaatccgcgtggaacatacacccgcagaggggccaatggagggaattacacgcgaggtagcggccgtggccgaggaaatggtgtcggcggtggcaacaacagccaatacccgggacgctcacagattccagcagaaggcggcaatggcagcagggtaaagcgctgggagcgacccatgacctccaccatgaggaatcaggggtcgctagaattcgaagaggacattgtcaatatgcctatggcccaggctgatgaggttcctgctgaggctttgcagaatcaccgcacagcctcaccgcggacacagcaggtgaaggattgtccctggctggactgggatatgtacctccctttagaaagtaatgtaactcgtcaagcaagtttttgggacttggggacctgtcactaaacggttataaaccgtcgttcattagactatcatgcagagcatgaatgcgttcagtggataagcgagtttcgacgttatatcatggcgtaccacttgcatggcatatctaaggttagcggtctaggttgtcaaactctgggtgtataccatacggcaagaaacgcaaagaacggagtctctaaaccgtagaacctgttttaggaacaacaagcttctttggagcgccgacgggttctcgtcgtgaacatcaaaaccatggcacaggcgtgcagcatacaagacctgatagagatcacagcccatcgacccacggtagtcactggatgcatcgcgctagctgcgattcaggtacgccaacaccttagcacatcttttacagtgatgataagcctagttgatcggtacccttatgctttctactatcgacgtctaggctctatacggagatgttgctgccaaggagatacggcagaagcgatttacagtccgcttggcttgctttgagaggataacgcatggaaaagatttgaaagcgaatctgattggtatgcgccgagcttcagatgtcattctagccatggttgcaggttgcattagcagagtactgatcgagcacatgctcacttcgtgcctttttttcactaggcaagatgatttgtgtcagaggaactgttgtcaggacgtcaggagtcaagccgctggccacgaagatggcttttacctgcaacacctgtcagagcgctcagacactggagtttccggatgcccgattcatttcgccaacaaaatgccatgaaaaaggctgcagaggtcgacaattcactccgcagcgaggggttggctatgacacagaaacggtcgactggcaaactgttcggtaactgatcgagtgataatgggaagcactctaccttcatgtttataagtttgctaaccggacgtcttatccttagactgcaagagaagctacctgatgatcggatggattcaggacgggtgccgaggactatcgagtgcgaagtcgtcaacgatttggttgatcgtgtgattcccggcgatgtcgttgagatcacagggatcgtaaaggtgtcgcagtccgagaagagtaagttttcactaatggattttcaaacgcaaaaggaagaggccagtgctccaggactaacttacgacgctgcttatcaggctattcccgcgcgaagacaggcaacacaatgtatctgttgtacattgatgtcaactatctgatcaagtcgaccatgaccctggaagatgacgacatgttgaatgagttcgagtcaaaagactctgccaaggacagcaaggacagcattcagatcacgaccaaggacctctatgccatcgaagaagtccacatggaaccccaactgttcaaactcatcgtcaactcgttcagccctgcgatctttgggcacgagatggtcaaagctggaatattattcgcactttttggcggaaggcgcagaagtaacactgccattgaccgcaccacgacacgatctgatcctcatgtgctagttgtcggagatccgggtcttggtaaatcgcagatgcttaccgctgctgtcaaagtagctccacgaggtgtttacgtgtgcgggagcagtggtatttccacaagtggtttgactgtcactcttgtgagaggatcaggatcggactttgcgctggaggctggagcccttgttcttgcagaccaaggctgctgctgtattgatgaatttgacaagatgactacggaccacaacgctctgctggaagctatggagcagcagtcgatcagcatcgccaaagccggcatcatttgtacactgcccgctcgtacaagcgtgatcgccgcggccaatcctgtgggcggtcattacaacatgtccaaaactgtggccgaaaacctgaagatgaacactgcactgctttcgcgcttcgacctcatctttatcctcatggacaaacccgacggcgagatggatcagtatttgtcaaggcacgtcatggctcttcactctggaaacccatccagctccccggcattcagaggaggcatgtcgcaggaaagtggcctaggtcagaccccattgtctcaggaaaatagggtcaagcctgagatggatcgtcctctttctgagcggttgcgcatgacggacgacgatcaactggagcttattcccttgccactcctccgaaagtacattgcctacgcccgccagtacgtacatcccaggctttcgccagaagctgccgcgacactccaggacttttacctgctacttcgagcccgacaccgctctccagatggtactcctgttaccacaagacagctcgagtccctcattaggatgtcagaagccaaagcccgcatggagctacgcgaggtcgtaacgcggagagatgccatggatgtcatcgagataatgcaagtgagatcaatcgtcggcacttggtatgggttaaaatgcacagtgattcttgctgtaagctaagcaatagggctgtgctttttctctggcgcatctaggagctttagcctgcaagaaacaatggcgccgggccaggcctcgggagctaatcaaagtcagggacaatctgggcgcggcaaaagcggcagcatgaagcggtaggtcattgtagcaaaaggcctctgttgcccattctggatgctgacaacatgcacactcaacgacttacgaaagatgtccctttggccacagatacgttgcggaactcaaccgggtctcgcatgcgacctccaacaatatgttttcgcatgaccagctctatcgaacgtttcaggaaatgcagcttcccgggatcactggcggttttcagtcgttcctggacacgctgaatcatcaagggttcctgctcaagaagggtccccgaagttatcagctcactacattcatgtagatagcgtcgacatgcatacacaatcacccctgactccgatgagtaacgacgcgggcttggatagtcatacacccaaaaaatttcaatcgatcgggcttgacactttgccgcgttcctcgccttgcttgacacgagggtgagccgaccggatacgtgtttttctttcgtcgtgcacatctgctctcaggattcccttcattcaaactctttccttcaatcaacacagctacttctcacttcggcagcatgacctcgtctaaaaagattgtcctcgtcaccggttgcaccactgggggcatcggttacgaaaccgcaaaggcattcgaaaaggtacttcctcggcattctcactccatgggacgttctttcgagggataaattcgcaatgaggattggggtcagtgactcatcatgcatacctctgcatcatgttgctgagacagaacggctgcaaggtgtatgccgctgccagacgcctggaagccataacggacattgaaggtgaggattatttactatgtaacctgcacgatattttggtgatgtagttcgcaggcattaaaataccttgactgcacacagggttggatattgaaaaggtctacatcgacgtactcgatgagaaatccatcaaagatgccgttaacgtaagatgctcgctgtcgcttgcgctagctttcttcgcatgttttccccatgctgattctcgagcttcttcttcaactcacaatagcacgttatcgaaaaggaaggacggattggtaaggcacaacgacaaggcctcgtctgacagacgattgttaaaaatttaatagagcagcgcattgacgtctccccctcttcccacattagatattctattcaacaatgctggaatgggtctcgcgtgcccactgatcgacatgtctgtatgtagcacagggcgggcgtttattggaaggcagacactgtatgggcggaagggcaagtgctgacatccagaccttcattgacgtgtatagatcgagacaactcgcaagctgctcgacaccaacatcacctcggtcattcttgtgtccaaagaagtcgcgccccatatgatcagacaaaagtccggtctgattgtcaacgttggctcggttacagcctatctgtcgacaccctggggcggtctgtatgctgcgagcaaggccgcagtccactccatctcagacgcgctgcgtatggagctggcaccctttggtgtcaatgtttcggtcgtggcgcccggtgcaatcaagtccaacatcggtgacaacaacttgaaggccttccatcttcctgagagtgcgttcagctattccgtctgcttgcagttgtgacgatattctattcgaactgatttctaactacgcgcgactgctttctgtattttccgttgtcaccttagagtctttttatcaatctgttatcagctatgtcatgtcccgagcgaatgcttctcaaggtagggcaaagcgatctttctgacgagcatcaatacagtgggtgctcaaaagagaaacctttgtgtatgagtttctgctggcttgagtctctgacactgtaactccactacatgttcatcagcccctggatgcacgcccactgccaactttgcaaagtatgtcgtggaaaaatgcctcaagtcctcgcctcctcgatacatcaattacggcacactctcaaacctcttccgattcctgcgctatgcgccttggatggtcacagactttatcttttctcgcaagtttggcttgaatgttcttcaaaagtcggtcaaggacggcaaggtcgtgcgaaagtaaaacaagacgcgttatataatttatgaatcaaagcacatcgcctactcaccttcgatatcgataaatctttcttaaccaagagctgcacaaaggatcagcaggagtgaagagcaggcatcgactccacttttctgaaaaaaagcgcagggtgcatcaagtgaactgtagggagagtgcggtctcctcttgctagtgttgaacagaactcggcccacccatcccttttccatgataccctcttcccctttttctgccaaccacgctctgtttgcgatgcctcactcctttataagcacactacgatcaatcaaaatcgatctccgcatccctcccctgctggctggtgtactcatgtgtttctcactctcttcgtttgctcctgacaagttggcgatgttgggaataaggatcgtccaaggtcttcgctctttgattatgagacagcccagctatgttctctctctttctctctttctttgtttcgatcggcccacttcctccacacttccttccaacaccacatatagtcctgcacgatttatcatgagaatcctctcaatctcccttggtctggccgctgtcgcgtatgtcgccgctcaaggtgagcaagtgtactggatatgaaatgaccatgacatgccttgctaaaattcgatgtcgctaacccttcacgaaaatggtcttgttcaaaaacccccctcagcggctgatccccttgcgcccgtcgacgctcaaagtaactttgcagtctcggccggtggatctgaggatcttgccttccgcgcagaagaggcttcaatgtcaatttccgagcttagtttccgtgccgagttcttgtccatgttcgacaagcagattgatttcaatgctgacgctgccaactgcgagggcgctaaactcatcatcacgaacgcggtcaagacggtccagggtgctgttactttcattagcaacacggttcccatcgtcgccccgattgctgtcttcttgaagaacaccttgacccagctcaacaacgtcgtcggcggtgtccttgagctctccaacggagcatcgctgattgccatcactattgcgttcaaggccgccattgctgcactgacgcccttctcgcttcccctcagtcctttggcgcctattttcgtacctttgattgaaaccctgaagagcattcagagcacagcactcgatctgatccgttgcgcaacaggcgctaccaagatcgagatgcaggctgctcactgcaactcgctggcagacctgtaccgtcttgtggttgacgactcgaccaagacgagcggagcgctgggtctgtctgctgaggcgtctgaggagctcaagagactgactgcgggatctgctgcggttttggagctcatgggcaagaactcgatcgcatccaacaacgaggcgctcctgtcgacgcgacccatctttgcggctgatgttctggaccagtaccgcatcgagctgttgcgcgcgaccgatgctgcagagaatgtcaagatctacgccgagacctcactcggtgtcgtcgtcggtatctcgaatgctctcgaggcctgcctccgcatcgctgctgacccagcgggagccatcgatgatctcaacgatgagctcgaggcccaggcacgctttgatgatatggatgatgaggatgatgaggaggtcgatgagaatgatatggaatgataggtgtaaactcactggaacatatctccctcacgctctctctctcacacacactcaataaagaatttgaaagcactgaccatgtcaaagtcaaagggtggaaagcaagtcacggacgtggtggccatattttaggggtcgaatgcacggatttgacgactcctctatttcttgtttgatttctcgaggtagagcagcagacatgtccgatggatgcatccatggaaccgcagcacccatcgatcatcccatcgccaccgtaccctcacatccccgtatctgccgcatcctcatcatgcaggagacttgtattccatggacagaccagagcttggcccagcggatgatcagatgttggacatggacagagaccaaagcaagacgatggatgcaatttccctgaaaggcggcgtgccatgatcactgcagcctttctttttgcaacaccctcccgaacgactcggagctcggaaaccatcaacaaaccaggactttggaaacatttctacagcctggctttctttgcaagtttgatggtgaaactaacatcaggattcgctaatcctcatcaaactagtttaagtcaagatggccaagtccaagaaccacaccaaccacaaccagagtatgtttctttcgccacttttcacacccctctgtcgtcccagcaggacataaacgctcagcggaggactccatcaggaccgacttgatatgggaggagctctcatggaactctgaagcgagaggggacctttgattcaaccaggaacaggagagatacgcgtgaggggcatgaatgagttacaaaagcctgtactacgactccacgcttgcagtattttcttccaaggcacgagtgtcgagcttttacgagaatgcaggccattactctgattcagttccgtccttgagatctactaaagggcgaccaacatctaccataaaggaacctatctaccgacgatccttgcttcaggaccaccattcagatctatcaacacattggaacgagtatactgcctccaggatcgcccgtcagcttttgttttgtgttcaggaaccagagggctggtcgaacacagcaacaaaaaaaaaagaaagacaatgcacctgttttctaaccaacagcaatttttccttcacaacagacaagaaggctcaccgtaatggaatcaagaaggtgaagtcccagcgtcacccttctctcaagggagtctgccccaagttcgtccgcaaccagcgcttcgccaagaagggttccgctgatgccctcaagaaggattaaatttgcgtctgggattgggccactctgtcatacccttgcgattctgtgaggaataaaaaaaccataacaaaagaaaagcgaaagggctaatataaactgccgtgtatagctgaagggatatctataggatggtatgcgagaacggcgcgttggaggatcgactgtcaaggagctgcactttggtatcaggcgcagagtgagcggtattacaatggtgttggatgcgtgcgcgccgactcgcagaacgcgcgtttctgctggcaggaccaagcatcccagtcgattaaacttcctcacgcattggcggcacatactctatctagagcagatagagctatgaccttctggcagtgggttacgcaggcagcatcgcatagctgcattggacccacgttgagcggttgggtcctatcagcttcacaatcaccgcttatgatgactaggattcaggatcacgttaacagtccgtgacactcctatggtagaaaacgggtagggaagagcgccaccaactggaagggctcgtctgtgaggggtcatgttggctgggcttctcgtctgttactagagattccgatctaaccctccgcttcctcaacctaccgccctttttgcaccgacacgaaaccgcacttgatccagtggttttatttcccctcctcctgtctcttccgaggccatctcgtgtaaaccaaggacttccccatgttgctctgagagacaaagctgaatgtcgccataaaaccaggatgttgctcgtctatccaggaacgcaaaaaaataatggggaaaatagagtttccgcgtctcctctcgtacctgttcacagttagaactcagccccgcattcttcgttttcttcgttttgggacacacaaacgaaaagagagctgcagaacactgtaggtcacttacaaacaaatcctttggctgagagaacgtggggaagctgctggtctacatgatcaggctcgacagcctatgattgtcacgaatcttattatcggtctttccgccactcccgccttaccacagaggttccaaggttgccagggtaccagaaagtcaagagtgcggggcggaaaggtctgctgggtctatacattgcaggtcatagttgtgccaccacaaacaagattgcacagaagaaatgaacagccagattccatcgcgactgcagtattactgtatctattcctatccgttcgcgagtgggtgcagagaacgataaaaaaaaagagtcgatctccgtcctaaacatggatccaatatgtgcggagtgagaacattggtacctggccgcttgtagacactggagtcgagtagcccctgagatagcatacacctcgatgcgtactgagtgtcatcaaacaaaaagatcaccgtatgcaccgaaagtgccaccgcctgtcacttctgagaatgagcgagaagaatgtggaatcaagctatggcaagcaagccgatgacaccctatgatttcaaacctgcgatcagagcggcaagaagggaataaaaatgcgggggaatgagaacgtttcctcctgaccagtgtgtatctgtactgttcaaaagtacagtacatgcatctgtaatacagcagggaaaaaagggaaaagaacaaagcagtgtccagcgatcggaagaacctggagcacttcggaagcagatgctgctgctattcgctgaggagattcaattgctgtcttgcggtgcctggaattgaccctcttgagaacgctgagtggccattgccatttacttagttggatctcagccagcacgcggctttcaagaaaaatgagaggagagcgcgcaaaacagaaccgtgggttacaaaagtggtacagtatatgtatagagataaggcctacaatacagtgaaatggctctgcgggggcggagagagttaaaaaaaaagaagtgttgtctctacagtatccatgaacaactggatgatttgcagtgcataaattcgcttcgcttgttcagtgtacatcagttcctgagcagttttgtcagcgaccggaagtgcggagtatgttgccacgctggaaaagagctgttacgtatctactgcatcctacgaagatctgttcttggcgaccaccccagtttttgaaatcgatagaaactcctacgaggtttttttatagcggcactcacattttttgatatgtacagtttgaaaggaggagcgctagatggtgctgggccatgtagccacaactcaatcagatcacgacaacgtctcaaccatgctacgaacgttgtgtatccaagcttgagaggcggtggaatgtaaacaaacgcaatgagctgtggctcgtgtcaagtaaccatgctgcaataacatgcaaaatagacaaaggcagagggccttcggatcaactcgtaagtatttcaagtcgtagtaacaggaggcgggcccgaacttttgtgtgcgtgcaaagagagcaagcgtagtgtaatctggatgttcaagtgaaatgcagtgatgcgagttctgaagtgacgaggttcttgcagaaaccggggaagagagcgctaggggtagaggaagatataggaagggattcaaaaaaaaaaaaaaaaaaaaaagcacgggcgacttttgtgcaatcgtgccatgcgctatgtgaatccataatcacctaatcaaaatccgattgcacatcattggagaaacggcattgagcgggcagttccctcttacctcctgcctttcacgagccaccgcgaagacttgacaacactgctagtctgagcaactagctgaagtcaactccctcctcccactaccgacctctgcgtccatggccttcagatgcctgctatgtgccggatcagcacaaacatcacacgtctgagtcaaggaacatgcgtgtagcaaggctaaggcaatatcaacagcagcaatgtcatcatcgtcgtgtttgccagcatcagcgtcaacaaaggcagcatagagaaaaaacaaaagccttgaatgtttactcgcctgcagctggccctcatgtgccgggttcaaggatcctgagaaatgactttagcctgggcgcggagggatatggaagcgagaacaaccgacctgtgtgttggagatgctatcgatccgaggccacattatgctgtatgtttggatgccgtaaaaatacgtaaggttagccgctgtggggggaacctatggtcaaataggctagctgccctcaggaagagcgagagcggtctggaaggcatggtccatgatgggtgcatttggtgtttttgcggatacggacatgtcagagcaccagagtgggactctattggtctttagactaaggggctaaggaccggctcgatatatacccccacactttccgattccttacagaatagatcacactgaattgggagcagtgagcaattgcacctgcgtcttatcttgcactgcgggagacttgaatatgtgtgaacgaggtgcgctgtgagacgacaacatgagcaatgaatcggagtcgcagcgagaaaattagaatacaggcatgcaattgagtagggcagcccaagtgagctcgagataaggagcaaacgacttcaggtcgttaaccttcttcgtctccacttttttgtcccatgctggctgactggaaatggaaatactaaacactggatacccactccttgccggtcgagcactataaagaccgccgtgctgtccgctgccgtcgttttttttttctctttcggtttttcttctggtctgttgttttctcgctttacatatcgtttttttcttttcgctttctgcctccactgttctccctcccttgctcactcctactctgccctcccacttccatttccagcacactccacccaaccaccaccagaccagtccagcttttcatgtcttcacttcacgcagccgccgactctctactgtctctttcatcgacccactctaccgcgccagacatcaacactatgaccatgatgatgaccaccatgaccacctcaccagcacccaaggaacaacagaagccttcgtccaccactcccaggagcggacaggatgctccacgcccttacaaatgccacatctgccccaagtccttccaccgcttggagcaccaaactcgtcatatccgcactcacaccggcgagcggcctcatcagtgttccttcgcaacgtgccagaagcgcttctcgcgctcggacgagttgaccaggcacatgcgcattcactctacgactaaagccaaaaaggagcgctcaacagcaccaccttgccacatctcgatcaagccttttatgaaggtcgtcatggtcgcctttgacagtgacagcaacagccagcatcgctcgtcgtcagtgtcctccacctcgccagcagcctcgcctcgcatgacgcccgcgattaagcagcagcagcagcacaggcagcagaccaatcgtgcttcgccttatccacaagctgctcgccgccacgcccagaaggagctttctccacccatggtgatggtccatcacccttctcccaccccttccctctcgagcaacacttcgcccgtgtcacagcttatgtcggactcggagtcggataccacagcgtcgcctctctttacgcccgaatcgtctcccgtgcctcattatcactctgccgctcaggagcatttccagcaacagcaccaggcaccgatccagtaccagtttcaaaacatgaacagcagcttctttagccagcccaatagccccaagatgatgacaaccatgttgccccctccagttctggcaccgttccgcccttctcagagcgtgactctgcctcccatctcggcgatcatgagctctttgttcatctaaaacatcttgccctctcgctcccctcccaagggggactttggctgaccctttggtccgtgggataccacacacaataccacacggcccatgtgtcatagatccgaaacttgtacatagatccatgctctgttttctctctttccttattgcttgtttgctgccattctcctgccacaatactgccaacactattaccctttacaactccctcccttcccccctgccaacaatagatagctccttgtaacatatctcaataataacaatgctctctttctcacttgaaacaatgtacatatgggtcttcacgctcatccatgctggctcgtaacaattagaacgtgcagacaaagaggaacatggggatttttttaggtgctcaggaaccggactggccgaattgagccaaagaaatcggagtgtggataagagagccgcttcttggtacaagcactgggtatcaatcagtatccgtgggtcaacatgtgcctgcgcccctcctagtggtgttgtccgtccatatgcacctcttcattcctgttgctcttgtccccctcatttcctttcactgttttctcgtttgaatcgactccaattgttgttggtttttttttcttctcacgatgggcgatgggcagaaggagatgtttatcgacttggtgcaagggtacaggtattattcaaccagaaagaaaaaatacgaagtaaaccacactctcattccccgcttggtaattcatgattgtgtgagcaggtgtgtccaaagtgcatgcatgctgaatccaggtttgacgctgttggacggacaagatagagagatgtttctgcatgtttgtgatccctccccgtcctccattccccgcatttccttttgtgtgcgattgtttgtgattatttctgtgtgcctatgtgggggaaaacctttttttttttcgatcgaatcaaacggggacggttgagggaacgagtggaatagattcgccttcaatttctcatccggagggaaacgtagcgctcgcctggtataaatatacaacacatttgtacactgtccttgcttcctggggtcgatggccgtcatgtccacccccgcaaatagtacagtactgtactccaaggttgtcctcaatgcgttcacctcacttttcgcaacgagaacccagaaggtgccccaggaccccagtatcccctcaggcgacacctcatcacccttcagtaaaacgcgaagcagagaaaatgaagaagaaaaaagtggagacagcgacagcaggcagacgattagaaacggtcatgtggaaggccatcagcatcctatgtgggccatggtagtataagcgcttgtgccttagttcgatttttaaggttttcgcactctgctcgtgcaacaattcgctgcaaaaccaccgtgcaggctgtataacatgccaaagagtcgtcttggaccgctggcatcgttgtataaggcgccaggtagccatcggcagccctagagtgaccacagcgctctaacataaatcataggcctgtgtgcctctttccgcatgcaggtttccaaatgcgctttttgacacatgctcattccaaccacttttcccgaggtcggagagtgtgcagaaaggcgtgaggcagtgttttcagcgattgctcatcttgaccatccgagttgcggattcgacctgaacataaaagtgagaaggtcgattcacgaccgcgaatcgtgcacattcacaaaacctattataattgcgaatcaagcagctcggacgaaagcgcacgctctggagaagccaaccatgccggcagcatcgtgatataatcgtttatacaccgctttatacaatgttgaagaccatttgcaagaacctgccctgatcggccaatgagaagcgccggatgaggttactatgggcacatacgaacataccagggccatagtagggccctaatagaaaagcacctgtgcctgaatgccatttttaaggttttcgcgctctgcccgttcaacaatttgctgcaaaaccgccgtgcaggctgtataacacgccagagaatcgtcgtggaccgttggcgcggctacccggggccccaggtgggtattgagagcccaggattaaatacagcgcactaacatagagtcataggcccgtgcgacgcgttccgcatgcaagtttgctaatgcactttttcaggtctgctcattcagactgcttttcctgaggtttgagagtgttgccattcgcacgaggcacagttttcgccgatcgctcatcttgatcatccgagttgcggattcgacccgaactccaaagagagaaaaggtcgattcacgaacgtgaatcttgcacattcacgaaacctattatatttgcgattcaagcagctcggtcgaaagcgcacgctctggagaggccaacagcaccagcagcatcgaaatataatcgatttatacaccgtttatacaatgttgaagaccatttgcaaggcctggctctggtcggccaatgagaggtgccagatggggtatatggatggcctatatgggccatttgaaaatacagagggcgtagtacgggccaaagtacaaaattgctggtagcctgcattggatttttaaggttttcgcgctctgcccgtgcaacaattcgctgcaaacgcaccatacaggctgtatattgctccaagcattgttgcgaactgttggcaccgctgctcaaagcacataatgccatcgagagccctagaatccttctgcactcttattgatagcgctagatctagcgtcagctgaccccatcttgcgaaggcgactttgctaatccaaatttcggagaatgattatggccacggctagaatgaaagccctcgctctggagaggccatccgtaccggtagcatcgagatataatggattatacatcggtttatacaaaattatacactgtcggatgggacatatgtatggtatatatgagccatttgaaaataccgaggtcatagttcaaaagtgtgcctaagtcactctgcccgtgcaacaattcgctgaagaagcaccgttcaggctgtataacacgccaaagagttgtcgtggaccattggtgctgctgcccaaggcgccaagtagccattcaaggttctagagcttcctcgcagcgctccaccatacagtaaaaccacttgtgcgctgctatcggaagcgagtttggctaatgcgatacttcgcgcctgatcattgcaaccacttttcccgacctttgagagtgtgctgaacatcgtgaggcactgttttcagcgattgctcatcgcgataatcggacctgcggaatcgagctgctcctcaaaggcagaaagatgatgaacgggtgcgaatatgaccaaattcgcggaaaattttacaatgtgtatattaagcgcatgggtctaagcgctcgctcgggagaagcgaaccgtaccagcagcatcgaattacaattgtttatgcaccggcaatgaccatttgaatgaaccagcccagattaaaagtatataggcgctggtaccctggacactatttggtttaaggtttttgcgctgtgtcaccgaaataaaacgctgcagaaacaccgtgcagcgcgccaaagagtcctcactggtcgcattgagtgcctggcgttgcctggcgtagccttcgagggcgccaggcaagcatcgcgagccctaaagtactctagcactcactctgatagcaaactatcgtcatctgaccccaccttgcgacggctaccttgctaatgaagatgttggagaatgatcggggtgtcttcattccgtcgaggtttcagagcgtgaagagtggtatgatgcagtcttttcagcgtttggcgatcttgacgacgtgagtagcggaatcgaccgattcgtcaagatgagggacctttggaatgatggcgagtctgggctgatttatgaattgaatcggacaagcgattcaagcggctcgggaaaaacgcacgctctggagaggccaaccgtaccagcagcatcgcaatagaacgccttttgcactgtcaatggccatttgaaagaatcggtcccccatcggccaatgagagacgccggatggggcaaggtgcatttgggccatatgagggtcctagggctcatagtaaagtcctagtagaaaagtgcgtgtgcctgaattctattttttaggtttacgcgcctgcccgtgcaacaattcgctgcaaaaccaccgtgcaggctgtatattgcgccaaagcattgttgcgaactgttggcaccctgctcaaagcacagaatgccatcgagagccctaaaatccttctgcactcttattgatagcgctagatctagcgtcagctgaccccatcttgcgaaggcgactttgctaattcaaattttggagaatgattaggatcacggctaggatgaaagccctcgctctggagaggccatccgcaccggtagtatcgagttataatggattatacatcggtttttacaagattatacactgtcagcgatcatttgcaagatccaaccctgatcggccaatgagaggtgccggatgggatatatggattgtcaggacacacgaggtatgctgtgagcgccaaaactgcttcagctcactgctgcatatagctagcgatgaataaaaaaaatgccaaacgataattctgatgccatcaaacttctgtgccttccttgacagtagcctgtccattcatagtgaaattgcgggcttgaaagcacggctaaggtcgcaagttgatttattgaagcagttttggcgcccactgtacgcgatcacaaaaggagacatgtcttgagacctcttgtggttcatctgcaaaaaacaacgaggcagccgggatgtgtccctcggtcaagtcctagtggtgctggggcttgaaagcgtccttctccttgcgtaaaaagtcttggacggacttgccttgatggccaagaatcttttgcaaatcgttcgaggcaaagccggccttgcccctcttgatcatctcaagctcatccagaagcagctcgatcatggcctcattagtgggatagtactcgcggccgtcatggccatgaccgccgccaccagcagcagtgggagcatcctcagagatatgcagcggcaggactggacggtgcatcagcgactcgagatacttcttaagctcgtcgcgctcgacgtgcctaaacttgatctcctttccgatggcatcgctcaactcgtggacaaagtgctcaggcgtgagctcattagggccggtgagggtgtacgtcttgttcttgtgagaaccgaatccctcaccttcgtgatcggtctcttgacattttttgatcacgatggaagtgatggcaccgacgagatcatgggcatcaagcggagtcatcttgttgtccttctcgatcgtcagagggaactcggccttttccttgacggcaaaggaccagaagaagaagcactggttgaggaagcccttgcgcaggatcaggtaacaggaagagcagcttttctgaacttgtttctcgagttcacagaaggactcgatcgacttgaggttgcaatcctcggaggctccgtcgcacgagatcatcatgcaggacttgacgccttgcttgttcatggcgtcaaggacgttcctgccgagctctgcacgacgctcgtccatctcggggaccagaaccgtgcagcggacaccttgaagagccttttcgagctggttcgtgtcgctgtagtcgaccttgacgacgtggacgttcttgagacccttgagcttgtcgaggaggtcggtgttgcgggcgagacagaccagggtgacctctttgcacttcttttcaagctcttgggcgaggccgtaggcagcgcagtagccaagccaggaatcgacgttggtgatagccacacgcttttcggaagatgactttgaaaacatggcaggtggtgaagggtggtgggttctcgttttggaaggggatatagccggctgctgagtgcttaacaagaagtttactgagtgtgaagatggaagagaaagagagagatagacaaacagagaggaagctggtctggagaacagtgatggatgccactgatgccctatttaaagcttcgcgtcttttttcaagccactaccgctcgagactccagcggcgatactcgtgcctgactgcaccactgactgcatttcagtcgtcgagggaatagcgtaaaaattaaaggttttggtacatgtatcgaggtcttcgcaccctattatgccaaccagcatcgttgcatgttcaaaaacctcgcgggtgaacaacctgtcggcgtggatcataaaccaaagagtgattgctagcggcttgtgcgccacaattggctcatcgccaaacacgaccgtacgacgtactggtgcgccctgctgctcacgcattgcggcggcaagctcgctcgcttgggcagcctgctcctcgctacgcttaaaggtcttgttgatttgctgcaaactagcgcagccagctcctacacatgcaattaatgcaaccgttatgcagcgaacaagtctcatcaatgccttccactttttcttttaacactgtttcgattaggcaatttagttttgagctagcgtgatacaaaacacagccttcaattacgatgatttagctaaaaatgtgcagtcgatgcttaccccaagcgtgggcagcatggctatttcctcttcgaccggcaccttaacagtaacggatgcgccagaagtattggcccgcgtagacagctatctgcaagatcaaaaccacaatctgactaagcaagtttcgctaaacgtcaaagtgctggccgttaccctaaccgataaaaacagcctgggtattgattggaacttattaatagtctacatgcgagactaggcgacaaaataattttaggtagccaatgttcaaggtatgccttaaagctgggccggcgccggctcagtggatgcgctatgtgattagatacgtgatgaggtatgcgactactgcgctgccgcatgagccaactcctgaacggcggtttttgcgtcttgattagagttcataaatttcgttactacatcgctgatggcgcctgcgatagcttcagactgtgccatcccgtgggcaagtgaacgaagatagctggcgtgcagaatggcggtgtcggccgcagcgtaggattgtttggcgcagctatcaaagcgtttcatcgaaacatctaagcgtgctggaatggcccctttatgcaaagcaaattgctcctcaaaagctgggctgccaattgttttagccatagccagttggccagaggtacagtagcttgtttatatgtcgtctttgcaaatcgacgcgttggtgggcgcacggcaaagccacatccgatccagcccagcgcactcccgccagggctgcgcgggattcgattccattgcccttctcaacacacagctcgatcccgtcaatacaaacatgcacattctcactagagcagaggaagagtacctctttaaaacactgaaagccaatgctctcaaggaatgcgaccctgttgtgaaaggtacacccaggcacccatgctatgcaagagcattaatttgaatcaagcacacctgcggtagggtctgctatgcgacatctttcactgacatgacgctcgactccaaacagagtttgtcgaatgcacacaaggaaagctgttctcagttctctggggctgcaggaaacaacataaggctatgaaccagtgtttaatggcgctgtatgtatctcgttatgaactggagaccattgtgaatacgagaccagtcaagtcgacgaatttaaagactaatgactgataccttctctcgctcctactataaaaccaacgcgacacatggacgatactcaggacaacacaatcagatatggacaagttgaagatccagtacctcaatgatttggcggagggcagggtcgaccatgccaaactgcagaaggagcagaagttgaaggaggaagagctcaagaaaaagagcaagagtaacggtccaggcgtccactagagcgagagcgcaaggaaacacagtacatccaataaaaatacagcatacaatgtaggaccattcaatgcctctctctccaaggacttgagaagaaaggctggttgatgggggtacacgatcacaatcctgaattctcagtaatggtcgatctgttgcacaaacacgcccacgtattgcttcacgacatctgcgtgccgcaacgccatttcctggtcgaacgcctctctggcttcgtctatatccttttgaaacgcttctttcgcctgtcgtgttggattagtcgcttcgactcgtgtctatcggtcaatcatacatgaacagtgagtcactaggcgataaagtgaaaggtggatcacagatggtgactttcccgtcatcttacttgtgagtcctgcgcgagatctcgttgtagcgcctgcagtttctcaagggttgtcgtggctatcaagttgtatggtttaagagaatggatcgtgctgtagcttcaggatgagcttatagagagcgtgggcgacagcatcccttgtgaggctctgcgctaaccttttgcactggtgtttccaaatcctgactcgagtgcgtccttggcgctgcttagccgcagaggtgtttcctgaagtgtcgagagtgtcgagctttggtggccatttaacgatgcgcgccttgtctagtatggacgagtcgaagcaaaaaaaaagagtggtgttggccagctgtggtgtatagtcgctattcgtagggggttggctgcaagagagcatatcccccatacctcaaactcgtggacaaaggtggtgacggcctcttcgacattggtctgtgggttgccgagaatgcgcgagaacaaatcgtgcacgtctagtgattttatgaaggaggaaatctcattagcatctgcactcttgctggaatgtggtggcaactgacagatgtgcgcgaggtggcgtttaaaggttgttgaatacctgtggaaatctcctgcatggtcaagagcgaagaaggatgggtggattttttcgcaggagggcaaagaaaaaaaaagtggctctgaaaaatgagagtctgaaactactgaaagcaccaagcacaaggtctatttagccagatcaggcaaaacaccctacctgaagacgtcgtcaacatcgtagagctacttcactttgggggccacagcttgatctcctagagagcgtaggtgacgatagctcgctatggctccggtcaagcacaccttggatagcggcacatacctcccgatgacctcgagaaaagacgcgaagtccgtgcgcttcgattttcaaatacggcgttgtggcgatcaagtaaagttccttgagagtacgatccccttctcatagtgatacaacgatacacctacacagtagtgtctttggtgagaagatccagtcatttgccacgaggttttcgtggtgaggcaccttcagtgtcaagtcgtcgctgcgacccatcttttctctgtgttgcaccaatctgctgaacagcataggtgtggcctttttttttgcgactggatgacgtcatactctctgactgcgctgaggcagttgctggttcagcaacttcgcttctgttcacccactgttcgattccacgggcacatcaccatgtaagtcagcatccacctatctctgctttgacttgtccatcacaatgctggctgcagctgcagctgctctcgaaggcgtggactggtgcagacaaggcaacaagtccgactagcaacgtgcagtgctgtccgtgtttgcgtgtgtgtgtgtgtttatggtgcatatacattgttcaaggcgcgttgctagcggcaatgcgataccacccttttgtcacccgtgtaccatgtgtggtgcatgggggtgtgcgtgcgtgtgcgtgcgtcgcttcctttgctctctcactcttaatccaccttgtttctgagccttggtgtggatgcgacttttttttgcttcctgcagacgcactttaaaactgttcgcttgctgactgcattcatttccatctcttgcttgttcgccattcgttcagtagacacgacaaccctcgaccaaggaaggcaaacaactccacccttaatcatctattcccgtggtcaacaacaccgtctgcaaacctaaaccgcccaaacataagacagagtccaaagcccgtcgttcgcttttcttcagctcgaccttcaactcgacctacagcagcaacaacttttttgaggataacactagagctgaacgcatggtcaaaagtcggacccgtgcacgtctaatcatcacccagtcaagaagaagagcaaaacaagcgtgctcgccttgaaccatcaccatcagcaactcttgaaccatgacagagcagcactacaaccccctcctgtaccagtcactggccaacggcccgaatgccgtgtactcgcccgcacagtcctcgcctggctccctcgtcggcacacctgcgacatctggttatcatctaggacacggaatggcactctacaatagtgttccacgctatcccgtccaaatgaatctcgcgcaaaagtttcagcagcagcagcaacaacagcagcaacagcagcaacagcaacagcaacaacaccaggccttgacacaccagcacttgcaacaacataatcaccatcagaaccaaatccgccagcagtcaggcctttcctcacctgccaccatcccagcgccgctcaccccccagctcggcgttgcatcctcccattatcagcagcaagttcactctgccaacctctcgcgtcagtgtgccacccctcactttagagctcgagccgctgcagcggtcgccaggagctctggtttgagctcagccatcactatcaccgaccccaacaatcctgcaaaagcaggcgctgcaaatggagaaggtgccgacaagactggaggcgcgacgggagccagtgcccaacagtggaccacgctcgatttaggtggcatgggacttaagaacattagtcgggagctgtttcagtacaactttctgactgcgctgtatatcaaccacaacaacctgcaccatatctcgcccgagatcagtcggctctctggtctaagtgttctggacgcctccggaaacaagttaactgctgtgccaccagagcttggaatgttgacgaatctcaaggaacttttgctggtcgataatggactggtaactctccccgcagagttgggaacgctttatcagctggagatccttgcgctggagggaaaccctttgaatgacagcctcaagaatttgcttcagcaggagggcacagccgctgtcgtgaattacctgcgggagaactgtccaggtagaacagctttctctttgtgttccttctcttgtctctgggtttgccgcagttgttcatgttggaagtatgactcacactcgcttgaatcactcgatagtcccacttcctccacccgagagagaatggatcacgctggaggacgccgactcgggaacatcatcgggtcaggacaccttcaccatgttttgttacaacatccttgccgagaactacgcgaccccgcagatgtacggctacaccccttcatgggcgcttacgtgggagtaccggaaggaactcattttgcaggagattctggcctacagcgctgatatcgtctgtcttcaggtaacttcattgtgtccacgtactatgagttgcacatgaccttaccccttcgtccatgccttttttttgactgatccatatgatatgatggcgcttattaggaagttgagctgggccagtacgaggattatttcaaggaccagatgaagcagcaagcggactatgatggtgtgttctggccaaagtcgcgtgcaaagacgatgcccgagaaggatcgcaggaacgtggatggatgtgctacgtttttcaaggcatcaaagtacgctgactcacggagcgcttattctcatactattctcatactactgatgctggcatcagttgaatgctccagtactaacgcgtcacttccatgctccggccaatcacccgttctgccttaggttcagtctggtcgacaagcacctcgtcgaattcaatcatgttgcgctgcagagaccagacttcaggaagactgatgacattttcaaccgcgtcatgaccaaggatcagatctcggtcgtcacattgctggaacacaaggataccaagaacaggatcgtggtcgccaacgctcacatctactgggacccgcttttcaaggacgtcaaattggtccaggtggccatgctaatggaagagctcgacaaactttcgacacaatgggcccatctgcccgtttcaggctcgaatgcgctgcctacgaactcgaccggcaagctgcccactcttatctgtggagacttcaattctgagcggtcatctggagtttttgagttcttggtcaagggagctgttgctcagggacacgacgactttggagaccacgcctacggcacctatacctctgagggtctgtcccacaagatgacgcttcggtcctcatacagcgaaggaacagagctgcctttcactaatttcacgcctacctttgcggccgtcatcgactacatcttttactcgtccaattttctctcggtcttgggtctcttgggcggggtcgagaaggagtacatgagccgagtggtaggattcccgaacgcgcacttcccgtcggaccatgtgcccatcctggccgagttcaagtttcgatctcaggtgacactgcccaaaggagcagcgcccaactttggcgccaccagcagcaacaggaacagccacagcagctccaagcagtagaagttacgagcagtcggagacttgtggagtgtaaaggagctttgtcggaaggtagttagaaagcccggggagagggtcgaaaggtcttgagttgagacttgtttattcgatttttgcgttggggttagaaatgtatcatagatgcagaagccatttttttttacccgtttttttcatttttttttcccttctctgtccatattccatgttatgttctttcaggaacaacgacagattttttcgtccttacttgttgtccattaaatcactttgtatccatgcctgttaaccttcaaacaaaaaaacacactttttttctggtctggtaacattttgaaacgacttcaatttttttttctgtctaatagtccatgaaccgatccgggaacgcgatgggtgccagaagcgagaatgcgtagatgccataacagatccaagaggatgcgaccttgacccacacagcggcccagctctgtccgatatagaccattccatcctgtccttcctcctttgtaaacgtattccagtttgtgaggaccatggcaatgtacatggcagcgagcgcaaagatcaagtggaaaaacgtgtagttgtactggcatccgttcttttcatcatcccgggcgtcgtactcggtgtcgtcgtcatcgtcgtcatcatcctcgtccagggccgacactggcaacgcactatacatgggcagagtcggaatcatgagaaaaattaaggatatgggtggagtgctttcacatcactactgccttatgtatcttgctaagattgcgaagctctagcacacgtacccgctctcgacagctgcgagtaaagcatccgatcggcgcatagaggaggaatttggaccattgttgatgagaggtacggcgctgtcagagttgaggggcgcatagtcgccattgttgatggtggcctttcctccctgcgtggcagctctggaggtggagtaagccactgccaggaaggtgaaaatggctcccatcagcatgctggtcctcctcgtccctctggccttgctgagagggttgcaattcgtctcaccctcgggctcattggcgactgcactgaggatcaagtaggtgcagtagatgacgaccatggacgactgcgccagtcctgatttggggtttgcctcctggactgcaggcatgatgcccactgcggtcaccaccatggcgaggagaaggttgaaggtgatgaaaaatatgttcaaaccgcatccggagctggcaaagaatccgtacatgatgcctgtgaggatgatagctcccagatacatgatcatggtcgatcccaccaaaatgaactgccatttgttggtgtcggacacttcccatttggcaatacaggtctcagaccaggtgtgggcgaaatccaccaggagaatcaaaccaaagagaataaagatgcctgcgcccatgagagccgtatagttgccataggacatgatgaatccagttgggataaagaacgaggcgacgacgagtgcgatccagacgatgacctttgggccccaccacctaatagaggagtggccattgttgcttagtatcaatgctggtttacctccaattaagcctttcagtccgccttattcctgctgctctgtcgatagcgttgcttacccgttctgaatagcggcacgcttggatcgagaatcatgaactccaatgagcaaagctccaagaatgcagtgaaatagagctagtgcgaatccaactcgttgtacctgcacatagtatggatgaagccatcagtcagaagggacataattacaaacaaagggcaactccggtttctgcatcatgacatgtgccaagccaataacgccagtagtgtcgtttaccccgaggttcccgtaacatgaagcgtcttcgcagttgagtttgaggtatccatgagtgacactttccagctgtttcgagccccatcctgacaataatgccaaggccacctatattggcaatgcagaggatatgtaggggtcttaatactgagtcagcgaagtggcgacaacgacgagttcagcatcgagacataccaatgagttgacgagcatgatgagctacgaccaacaatagcaaaaaaaaaagaaaccacgacctcgattagaaccctcaatcagtgagcacaggtagtctgaaccgttgagaacagcgcaagagtaggtgtttttctgttcgtacggcgtatcccacgcgtgttgcgatagagttgttgcagttgcatgagcggcatgcgagcgagcaggcggctgctgagaagcaggaggcaaggatggatcccacaccgccgagtgcaggcagggcgaggaagctgagaacggcgcccatgtggctgattcctagcttgtgcgtatgagagagagtgaggagagacgacgacggggatggagatgggatgtggcaaatgtggcagcgtgcgagagtggagtgcttggcaagacggatgggtcatgcgtcgttgtgaaccagctgagaatgtattttgacagactgctgataccgtgactctgtgccgcaccccctcgtgcatgccgattgaccgctacgtcggtgcgctgtgcccagtcggcaaagtccgcttgggccaggtcagaaaaaaagtgggtccagcccataagagttgcagacgctggcgcaccggtcattcatctctcacctccaccccgctcagcatcagcagcatccacagcaccaccagcggcaccatccacaccctagacagccccatgcagcaccacctgtcgctcattcctctgtaccctcctcgtgctctgttccttctcgctctctgatctccttttctctgccactagcttgactattccctcccgcccttggctggcctgttggctcgatagccctattcctaccacgttggcccacagatccaagctcacccctgtatttgctttgttgatgtcccacattgatgtgcttcctgcagagatcctcgcccacatcttcagccacgaaggcctggccgacatcacacgccaggtctgcagtcgctggcgtgggatcgccctccccatctggctgaggcgactctccctccttccaagcgaccccttcaaggacctgggcatgctagcgtatctccagggcctttcggagcacgatcgtctctatgtccgtgcgctcgacatcacctctagacgcgagggcgatgtcaacagctctgtcttctacactgaaatcgccgatcaagcctgcgtccagaacgtgctcaatatccagtcccttctgggcccgaggatcgtggaacttgccatcaccgacacgggctgggcatccagcagcatcgccgatatcctgaacatgaacctgctcatgactcgacatctacaccatttccaaatctcgctctacgacgttgactccttcgagttgccggatctggcccaagctctgacccacctatatcaacgcgatgctggtcatctcaaatccatcacactcgacctcgcccagcccgtcgctcgggagcagtggttggccatggccgagtgcacggagcttcaacgatgtcactttggactctatcgatccacggaacccgtcctagccgagatctttgagcttgtgctccctcgatgggaagctctcactgagctctacatttgccagccacggcccttgtcggcagacgtcgtcagctgtctccatcggcaccttccgcgcccggatcgcttacgggagctgcatttgatctttgaggcctgccaagcgtccttgtacgagcaagagttcattgacatgatccacgccatgcccgggctccagacgcttgaggctcacttggactggacgaatcggatgatggaacatgtggccatgacgcttccggacctgcgagaactctcggtcacttgttccagcctgagctttacctgtgcagggatccagtacatggtatggggccaggcgctcgagaaagtgaacatgaggacgtcaggaaagatttggagcgggtttctggacgcggtgaggaagcgatcacgtcgtgtcaaaatcctcgtgtacggctcgatgaaatggggaggagcggtggatgagtgggaataaaggacgtcaaagtgctaccgtacagaacgctaccacagtacgcgttttacaccgtatatccttttcgtggtcccaaggagtggcctcgctgattaatgcttttcatctgtttcttatccactttcctatttatcttcagggctggctagtcttcctcagtcttccgttgtattacaagctaggaggtatccacagagaaggaaatctacactcaacagctcgaccagacgatgtcaagaatgcgtcgatgccattgaacacgttcactagaagggaagtttggaaggtggcggtggggtgagagagagagagagggacagagagagaagcgtaagaaaaaaagtttggtttctttagcagcctgtcttgcaccgctttctcaatactatttacacgtaccatcggctcgcacgactgcgtgatcagacatgtcgtttgggcaccagtcctgcaagagctgattgcgaacattcggacttgggcctcggaggtagccatttgtgtagggggtcactatttcatccgtcctatatccgttttttttgttcatgctgtcatcagtgcatgcaagtgcaatgatcatccagccgagtatctctctcagttgtgcttacatggtcacgatcaggagatattgtacgccaggaacgacgtccccatctgcatataaatcccttatgaaggtgctattgaggcgagcttggaagcatgatgcgcatatcggatcaagcgcctacaaaaggttatccacgttcgatatcatatctgtgtgatgagttttcgccgtttactgcacatagaactagtccatcgcttcggagacccattcctaggctcaccttcataacgggatccaaaaggcccaaggtttccgcaagagtcactagcccactcaaagtagtgccacgttgaacgggtccgatcgccgcatgtttttctggaacaaagtacaattggtttaaaaaagcggcaatcggaaaaaaaaagtgctgcacaatgtctaatacccaggttagcctaccgacgctgagtcccccatggagtcgcttcatgtaatactgacacaccaagctgccctatttttcgaagcaatgtagacagccatcgtctgtcagttgtcagaacatagcttgatgttcgttcaaaaagccactggtcagtcctaagtctcagtcgcttaccgccgaatagctgagcaaatcgactttactcgcgccagtggccttcaagacctttgcagtaaagtctgaaagctgctgagcactgttttccatcttatccaggccataaacgaagggaacagaattcaatccgccatgatcctgagcaaagacacaatatccttgcgaccggaagaacgatatcatgaagggtagatggttcatgacattgccaatcagcccatggacgaggatcaggggtcgaggtcgatcgcttgaaggctggcagtcccaatcattagggtgaagtaaagattctaccatcgacagagcatttccgtcggccgactcttgtggaagtggtgaggatcgaacacagaagtccagcaacgacagtaatgccaacgtgattgcagcgagtacccttatattatgcatatgaacgtaaagagacctatcgttaaggacgatgaaatggagaagtgaatgaggttgggatgaagacgttgaaagatgggggaaaacaggaggagttgaggtcgttgagggattagacaaagctgctcaagatgctcttttttgacttaatatgggacttctgaaggacatgccgagatgccccctttcacgcacttgggaggtgtctcctttcaaggaggactccaagataccgccctatttttgttttttgtcaccctgcttttaactgaaggagaaacgttcaagtcttgattctgagccagacgcgggccattgttcaacatgatcttgcgttccagacttcaaaatgacgctttacagaccccatatttatgcagaatcaagcccttttccgctggtagagggccggataaaggaaggatgctctgtcgtatctcaacgcgttgctgctcatgttctagcaaactacagcgtgtcgaccgttttttttcgtccggcaggacctgtgctacttgatacagttagacggttgcagtcactttcatttctatgcaggtttttactgtcgctcctgcacctgctcttgcttatagtctcgctcgaggccttgctcttgattcctgagacttttgaatgctatagcgtggctgcttgtggtgaacagaaacatgctgcattttcagggcgccctatggatttaaggttgcagtgtcgttcctggaaggaccttgacatcattcatgatcttgaattcgacactggactgcaccaaaatgaccagctcgaccgagagattgcaacggaccaagtctggcttcatgaggaggatgtgtcagatcctgcacatcttggatcatggtcgtcgacgcgacttgcgcacctcgacgatcgtgacatcacccatgatgccagattcgacatttgactgcaccaaaatgaccagctcgaccgtgagaatgcaacggaccaagtccggcttcatggggaggatgtgtcagatcctgcacatcttggattgcggtcatcgacgcgacttgcacacctcgacgatcgcgacatcgcccatgattccagattcgactttcaagtgcaccaaaaggaccagctccgtcgtgcgaatgcaacggaccaggtccggcttcttgaggacgatgtgtcagattcgcaccatccgtgatcgcgtcagcgcaggactaccttggaactcatgcactctgattcactacttgtgtttttttcggtcttttgccatagtgaatttgaagacgatggagagcgaagatgacggtgtccgagctgttgcattcaagtcgttagcaccttgggacgattcgaagcgatttccatccacttagacccctgtgcattgctgaagggatccctgtgaaattgaaggcacacacttgcgtgaaataaggtataacggttttctgagtgatcgagcacggaccagtgatcacccctgaaagactctccccttttgaagatccttttgaccatgtccaatccttcgatatacatccaaccatggttctcttgccgagaatgaggggtgtgccactggtgaacgcacccggtctacagagaagaacgatcgcacagctaagaatgcccaacatgacgcctttgcatttttttagaggctatatcggcctgcaggcgcgtgttatatggttgaaaagtgcgtgctatttctcactgtcaaagcaggagctgaggggtgactttgcagtcagcgttgctttgaatggatggcttcacttgccttgcatcactggccgtcaaagattgggatatgcgtcttgagtttgctgccggccatcttaggaaggtagttatgccccttggtggcacagttactgtacaggcgggagtttaagtggtgccatcgacaggcgaggcggttctaggcaacaacctgccccgtgtaatgacaggacagatatttgttagtctaaccaacaacgccagcggaatcttgaaaaacaaaccaaaaaatggcacgaaaatgacacgtcagtttttctgcgatagcggagtctaaggaagacgtgtataaggactgagaagcaagtagtctagaaaacaaagacaaaaacaaaataaaaaggtcagcgagcgaccacacatcaacatccattcgaggatggctattattactaaagcaaaaaaaaaaaaagataagaagggtgtggtatttgaattacgctacaattactattgtttttttttctttacgtctcgcctatgcgcatgcattgagatcatatctactctgtgctggcgttgagaggcgaaaaggagcacgagcacgagcaacatgagagcgccgagcaagctacgctagctttggagagtgatttttttggcatggacgcgcacagtgcacaaatctaggaaagggcgctacaccacaaaaagaccgttgttgaacatggtcgagctagtgagagccttgcgcaccaatcgcatcaaactacggtcggagaggagcgcgaggacgcataccctttgggatatccaagatctcccaggaccctatcttgcctaccgtctggttggctgctccccctcctcctcttcctctgccctctcccctgcatgacaccccagctttcgtgaaatgtaccctggccatcgcattacgacgcgcgccacgagatagcgatgcggtatgtagtcgaatgagttgcttccaacggaaaaacgaggcgtcaggggactaacaacaatgtgtcccggctgaaattaagttaatgagtggtttcattgcctccatcccctcccaccatcgccgcttgatcattgcgcgcactccaaagtaatccgcaagaccaattgccagcattcaaacctacgctggaaaagacccatatgagagcccatgtcatagtctctcatctcttgttcctttttcatttccgccctttttggacctctcttttccatgttccttttgggcgtgcactttgacacatacggacacccggttcatattactaactagacattcatgggccacgaggacaccgccgttaattgcttgagttattgtgaacagaaaagaaaaattgaaatgcaggcacggatggagtgcagcagtcggcgggagctgatggaggcttaccgaggtggtgggggggggggggggggggaggagggaggagggggaggcatgagatgcaggtccagggacgattgtccgcttcccctgcttgatcctgatcctgatcctgatcccgcccgttaccgtgcccccctgtcctgtcgtcttttatttgttgttctttgtgtctctggcccttgagttggctggatctttccctggcccatacgtctgttcgcttgtgcatgaagatcttttttttcatcggaatacaagccgggacagagttgcacgcgctgagagcggttgaacgcgagggtcaatttaatggtggtgcagcgtttccacgagcgcgggaggaaaataaaaaaaacaacaaacatcgagatggatgcatggttgtgtcctaggtgggctgcaaacccatgggggtcttcgctttcagctgaatcgtattttaaattgccatgttgagttggtacaaccttactaaattgcgtttgaatttttgagtagcagcagttgtgtgctgagctggtgcttggtccttgttttgagctgagtcgttgtcgtgtgagacttgagacgccttgctccctccccctgcccccgatccgaacctgcctttcttctgttttattttagccctgcatgtctatataacacccacattccacccaccttcctggatcgtttctcttcatccgcttccacttgtacatacctccctctcgatcctcattctgcaaccccccccccccctcctcttctggttcgctctcatattccacgaccagatactatatacccctcatcatcctcaaccgatcgctacagcagaataaaaaaaaagagtacatagatcatcagcatggcacctattccaagactcgctgctggaccactgtccatcatcacgggcgcactcttccatgctctctcagggcccaacagcgcccctccctccaatggcgcgaacgccaccctctgggggactgaatataccggaacggcctccttcaaggatctcaaactcgacaccacccttccatcgcctgtctcccctacaccttcctccactgcatccttctcggcctcatcctctcctacctcctctgcatcgtcatcatcatcatcatctgcagcagcagcagtcgcagtagcgtcccctatctccaccagcaacagctctctcgtctactacaacaccgcgacagactcatacaagggctgcaaggaccaaaccttctcgtccagtgaccccgtcgcgctcatgaaccccctccagttcggagacctgagctccaccaactcgacctgtagtcaatggatccaggtccggaaccgcgagaacacggctcaggcgacatgggccaaagtggtagggatctgtgatgagtgtgagtatggttcggtggccctgaaccgaccagcgctcgaggatctggtcccgcaagtaccgtggaaggacttggtgtttgatccccaatcgaacgtgacgctgcccgaggtggtgatggtcgagggcgagacggcggtggtgtcgcccaaggacctggtccatattgtttgggagctttcgaagggaccttcctcctcggatccgagtcctcaagtgcccgtgttgacgacgacggcgacgcctactgtctcgaatgctgtgccaacagagacggcaacagcaactataacaacaacgacgacgacgacgacaacaacgacgacgacaacaacgacgacgacaacaacgacgaggaccaaggcgcccaagccaacaaagaccaaggcacccaagcctattgaagatcctaaacctccaggtggaggggatgggaagcagtactcgggtcggatgacttggtactcggatacgttcggccaatgcgaagagagttactcccagtcggatctcattgtcgcggtcaatgaaggtaagaaaacacactgaaaagagaaacactgccatgcattttttttttatattcttctgagtctgacggatggagaaaaagaatctaacggaccggtgtgtgatctcctcgtgtttctagcacaaatgggcggaggcaagaaactgtgtggcaaaaagatcctgttgacggagaagggatccaacaccaaggtcgtggtcaaggtcgtggacatgtgcccgggcaagtactgcaagtttggtgacttggacctatcccaagctgcgttcaagcgcttcgctggcctcggaaagggtgtcctgcaactgcagtggagctttttgtaaatgaaaataagaaaataagaaaataagaaaacatctgatccttcctcgatagcatagacgcctagaaaagacactttcgtttcaatggagtccttacaacaaaaccccccctcctgtattctaccccccttaaaacatgctacctcgcgtcttcatagtcataatacaagccatggcatctattattttttttcgcatgtacggtaccttctagtccaaaatcgaaacacattccgcgtcctggacgcgggtttcgagaacagggtgcggcacccttcgttcagaattgtttcatgcaggtgcacaggcattctttcgcatacaagtggaattggcaaaacgggtgcatacgccccctgtttgaatgccgaaaatctcgcgatctttatgatgaaataccgtacgactgcgcgtagattgaggcgaaggcctgtcaaaggcgggaagggggggaaggaagggaggttacaggtggaatgcgtgatatgggtgatataggatgatatactaaactacaaaacaaaaatggtgcctaggatcgcaaaggtgcgagcattgagagcgaagagagggggggggggggggaggaacaaccaagaaacacacaacatgagtcctagaggtagaggctacatgttagaagccttcgagtccctgtctcgattaccatcccaaaatatcataatctcctcgccatcgcccctggtcgaggaccgcgcgtccgatatggtcgagaaggtcgagtctcgcatggtggtggagccagagttggtccatggacgcaaattgggttctggaaggtcggaaagaggcgacgacggatcgtaatgatggtctccaagggtaatgggtatcgaggcaaagaccgttgtagagtccgacatgggtgacgagggtgcggatgagtaggccgtattccgatccgagggacacgttgctgccgtctcagagagcgacaggaatgggttcgaggaccgatgtgagggcgtgggggaaggtgaagagacgttgatgttggcattagggtcgtagcttggctttaaagatggcgatagggaagatcctcctgcgccagcagacagctctgcttggctcatgaaggggttgtgggcgtggtcgcttcctgaggttgatacagcagacggccgccttgccccacgacctcttactcgcgtatcccggctctgactatcactatcggattcttgctccgaatcggactctgcactcccatgggagcctccagctaatggtgaggactttgtattacttttcgcatctgccaaccgcctctgcgactttgatcgctttatggagttggagctgtgcagggtgttggaccgctggatgaggttcgactgtgttgctttgatagtgttgagcctcatgacctgaggtgttgcctttgatgtgacagccatgaccaccgcctcatccagaattccagacatgtgtgacgcgacagagtcgtgtttgcggtcgtcatcgcgtgttggtgcaaagcgtggttgtgctaaatgatagtcaacaagggcagtgggtcagtgattgtgttatttttctctccacccaatggctgatcttccagagagcatgagtacagtgcccatacctccgcccaagttggcagtagggtctggggcagcaatggggctctcgccgatcatgcttgggatatatgcgatgcggatgacatccttgtgtccgagttcactgctggagttctaggtggataaaaagtttgagaccgatacgcagattagtccaagcacgtcctccgagggcgttttcttctttagcttaggcttggcctggccctgaaaccaagaaccaaaacttcgagcgcagagcccacactatcatcgttctcgctgttaaggattgtcggtctagaacagctagcgggccacagttgttgctgctggatgtcgaatgtcgcttcccgcgcaaacgaagaagagaagtccctcaactgagcattggtatgctatgccgtgctagttggcgtgtctttcctgtgcttgcttcctgctccacaaaaaaaaaaaaaaatgctggttgctgcgctaggtccttgtgctctgcaagagttctattttctctcgtgtacttgttctaaatccatactgcaacgcctgtgtatcttcatgcgcctgatccgagtgagtcgatgcctgcggccggatggtgttgtggttggtgtcgggaccatgtatattaatagcgcctgctgtccgtttttttctttctttgcagtctagggaggagaaacccgcagcgagaacgaggtgctctgtcgcagcgtagtgtagacatgccggtgttcgggcagctctgtgttggctctgcttgcttgtgttgcttatgtatgctgacgctgcatgaacaggttttgtgcagacggaggagaggcatcgaagggcacattttgcttaccgagtgccagcgctttgagaacgagtcgagggagtcgtcctgtccggacatgatgtttgacacgcgcctcatgcgtcgctgtcgtcgccgccttcgtatcacaaggaaggcaatcaacgccacgacgcccagacctgctattgcgccgacaacagggccgaccgcggacggcttggagggggacggggtgttggagtcgtctccatctgcgcccgtgtcaaagtcgggcgtcttgacgcagctggcgatgggacaggcgcactgtgagtcgggcacgctgaggcggcaggtgaatccggtcaggcactggggcgcacacactttgggcggacagggcggacatgtcggcgttgaggacattacgaagccttctgggcctgttgctgtgttggcaggcggtggttatggtttgtgcgtggatgtgtggatgaggcaggaaatagacggctagagagcgacggagaatgggcgctggaggaggagagctggaggagagtgccctgaattagatcaagcggggtggcgacagagaaggagagtgagagagagcgaggcgaggccagaggtgagcaaacgggctggagggacaggcgatgaggcaggggggaagggaaggaatgaaggactgaaggactgaaggattgaaggactgaggattgaggatgaggatgaggatgaggatcaggatgagaatgaggatgaggaagaggaagagggacaaggacggagggatggaaagaggggatggagcgcagatgcagatgcagatgcagaggcgagaggggagcgagaggcgggctgaagaagagggcgagcgagcgagcgagagagagagcgagagagagagccacatcgtgggcgtgtgtttacagtcgctgttgtcgttttggagcgggttgctcacatccacacccctgtgggcgcatcgggcgcccttcgcgaggtgctgcgatcggataccctcctcctccttctctctccttctgctccttctctctccttcactctctctctcactctctctctctctttctctctctttctctctctctgactgcactcgctctctctctcgatgcagtggcaaagtacacataaacagactcgcaaaacgcgaatgggaagcgtgcgatttctgtgccccgtgcatgaaccttgctccatctctcgtcctgctcttggctcgcgctcctcaaatgccgtcagcctcgagccctattgtccctatcagcaacccttcttcccagaggtgagcttgggcctgcctcgctgtctccaatgggccaaagggagccccattgcgcaagatgatcaacgtgcatccagagtccctcttcccgcgcgtcgccccctattttggatcgggtagcgttggctgtggtcctgttcttgggcaagggggaagggcaaaacaaaaaaaaagagacgatggtctggctcgcatgttgcatcgtcgccgtcggctcgagacagcaagaccaaggactgaggaccaggtgcatccgacaagtgtcaagcagagctaaaagcacagactttatgcaaaccacggcaaatttcgacttgttcaaaaatcacatctttctcaaggactgatgcctttttttgattcttttcgttctcgtttcctgttctcttcattctcttcatcctcttcatcctcgcccctgttcccttcacagccccctcatcatcgactcttgcttcgttgcacatcctgccagtgttattgacacagccttcgccatgaagtccgagcagccagagctgtggtctccgcctccttcctcctccgcctccacctcgacggcctcactctcgggcgaggacgtcgatgctgaggatcgacctgtctacgacacggatgaactgcagcatccgtcctcagactcggctctcaacacggacgcgtccgacagcaacgccgagacctcctcgcaggatcctcccacgcgacagcatcctgcacctgcgacactcgcttcccaggaaagcaccaactcgttgccactgcaccacaggaccgattcggattcctcatccgaccccgacatggatttctgcatcgtggaacgagtcgacaagcaagagtctcttgacgatcatgtcgtccctccaagtgcaacgcagcgcatggagctagagtctgttcctgccacagcgaccgtgcccgctatcaaggcgactcaaccgcaccaagtcgcagcgggagaacaagaagcttcgccgagccagctcctgccaagcttgttggattatgatgctatcctgacgaccgtcaccgccaccgccaccaacacaaccgcaacaacaaccaccaccagtgcagtcaagggagtaactcgcctcgccttggaccctgctcggcccatccagaccgcaaagagatgctacccctctcccaccgagcccatcctgaccgcaaggagcgaccgcttttctccctacccctaccccttccttcacacgtccatgcctacagaaacagaatcctcgttgtccaggaacaagagccacttttcttccacctctaagcctacaaagacgcaatcctcagtgtccaggaacaagagacgatcgtttgctcaagaatcacagctctttatgctcgcagtcctgggcgcaatcggcgtcagcatcctgctccttctgggcatagtctgggccctccgttccgctcgatccaccagcgtccagccaccctcgcatgcctttgtccgacacgtggactatagctccgacggcctcatgggcatcatccatatcgatctgtacaccagcaaaggaacgcccttcctcagccaccgcgtccatccctttcatatcagggtcaatctcggcgatcaaagcaaaaagaactggaccccgcaaacgaccccgaggagggcacaaacaaatatgcccgacttgaacgcgcccttggtacaggatctgggcaacggtacctacaggctgcacctccaccgcccggatcgggcgcactatcgccagcagaagccactgagccagaatcagcatccatatcaggctcaagatcaggatcaggatcaggttcatgcaaccgagctcaagttcaagtcgtggctctgccccgagatgtcgccgtattatcttcatctctggttcgagaacgggacccgcgtcccggacacgccgcacagactcgaatggtcgtccacagccgtacctttgcatcccaaagcatcatcacgtacggcaagcgccacgacatcatccagcggagccgtgtttgagcatcgtcaccatcaggatagccaagagcaaggcgcgatgcgggtatggacccatggactgcagccagtgctgtgtgagctctacaggatctcagacgctgtgatgtcgttcacgtttctgatgtccaagatcgtcctcagtctcgttgcacattcgatcgatcggttggtgggaatcgaagactttgcatatacacatgcggtcaagggttggatgcgcgctcaactccacttgaaggtgttgatctccaaggcctcgtctttctgcgggcaagcgacaaaacatccagtctcccatcacggcgcctctttttcaccgtcctctgcccctgcccatactcctgttcctgttcctgttcctgcccctggttctgtatctgaacagaaggctcccacagatctggtcattctcttgcatgaacacgtccaatctctcacgagagctgtagggcgagtcaatctcctggctgcgggctaccagcaccttccaacagctgagaaggtactcgacacggccgataggatcctggtggtggtggaggagcatgtggtgaaattgatccagtccgagcgtgtccaaaggatctctcagcatctccaggccgagaaagtccttcacgcggccgaccgagtgttcctgaagacagaactaggactggaacgctggctcaagaccgatgccgttcagaaggtgaaccggcgtctgaagcgtcaaatggaggagctccaggccactccgcaaggtcaacgatggtctcatcggtggcagggcctgcgagaaagactcgattgcagacggacttgattccaaactgtcgcttttgaagcaagatgatcgaaagaacccttgtctcctgtgatcccattgtacagcaaatttgcgatctggcccaaaaaacccccgtaataaagggaaatgcgagttgtcgaccttcattcatcccagttatcattcttgttcttgtgtccgtatttttcgtctgtgctcttttcttatattacaatcttgaagtccgaggatgtggtgccggtgccaggcgggggtgcgagaagctgtggggagtgattttttgctggctaactcgacaatgggccttgaaagtaggtgtgtccaaactcttcgtccaccggtactgagctatggcgtgttgttgctgttcctgtcgtcgtggatgtcgtcctgagggacggagcatgtccaccgccaccactagacccagaagacccaaaagctatcgaggaccctcctagtgctccaatcctagaggatccagcgcctgtcgttgtgctggaagcagatactggtatgaaggaggacgcggatgacgacgacgcgagagggttgaacaagcctgtgctagctgaggtggccgacgatccatgtgactgttcactgctcgccacatccttttgtttccgttgtgcagccggcgtatgctcatgaggaggttgtggctgtccggtgagatgactggaatttccaaaagacgaaaaaaacaaacgatgagttcttcatgaagtataaacagcacaaaggcaaaaggaaggaataggaacgaagagagaaagggaagggtagcataagcattgggggacgacaattgaagagttgtgcttaccggtacattctcaaccttgctttagtcggcgtctaaatgtccacagtgtcaatatagtgtcagcgactgtagtatactcccacacataagtcggcacgcttttgaaaggctgctttctcagccttctccctagttgtcgtttgaagacttacctcgttcatggacaacgcatggaggaggaggaccgagtggtcgtgtagagctgtggcggcgcgctgcttaatttccttctcgacagcgctgtcctggtaagctcgaggcgagaacgggtctgggtttgacgaagcaccttgcaacgaggcatggggcgatggttgtagtccgtccgttgccattgttttgatgtaaggacttttttggtttatgtgtcgattctggagtatgtttagctgctgttagtgagagaggagatgaccaaaagagagaggcgtgaagacacagaggagtggaagaagaagaagaagaagaagaagaagaagaagaagcaggcgacaggttgacggtgaaggatggacgaggtgaaatgcagagtgaagaataaagcgtaaagtgcgaggagtctaaaatgcagcaacgagtgcatcgagaaaggcggaaagatggcttagctcagtcgcaccttgcaggtgggcaaacacttatacttccagtcacctgcatggacggtaggggaccgttggaaagtggtattcccccgtcgaaatcggacccagtcccgtccagggatagatagcccgtggtttgacccgagttgtcatcgtggtctcgcttgcccaccgcaattcttgcagtgtaagaggcgtccctttttctttcttttgcggcggcacccgccacaaggttgggaagtcttgtactcggaaacatagtgcataggaatgcccgcccttcgtgcctatggtcgtatccagacacaatgaacaaaaagaggtaacaatcagtactcctgggtcatcttttgatatccacgcggtgccattcacatgttctaatactcattctcagcgtagaagaaagtgctcgagaactcgtatcttactctatgctagagtgctgctggaagctctaggacttctgagggctacctggcgcccgaggcagccttgccagcggtttgtgaggacactttggtgcaatatacaggctgcacggtggtatttgcagcgaacgggcagagtgacttaggcacacttttgaaccatgacctcggtattttcaaatggctcatatataccatacatatgtcccatccgacagtgtataattttgtataaaccgatgtataatccattatatctcgatgctaccggtacggatggcctctctagagcgagggctttcattctagccgtggctataatcattctccaaaatttggattggcaaagtcgctttcgcaagatgggtcagctgccgctagatctagcgccatcaataagagtgcaaaaggattctagggctctcgatggcattctgtgctttgagcagcggtgccaacggttcgcaacgatgctttggcgcaatatacagcctgcatggtgggtttgcagcgaattgttgcacgggcagagcgcgaaaaccttaaaaatccaatgcagactaccagcagttttgtactatggcccctactatgccctctgtattttcaaatggcccatatagaccttccatataccccatctggcacctctcattggccgatcagggccaggtcttgcaaatggtcttcaacgttgtataaacggtgtataaacccattatatttcgatgctgctggtgctgttggcctctccagagcgtgcgctttcgaccgagctgcttgaatcgcaaatataataggtttcgtgaatgtgcaagattcacgttcgtgaatcgaccttttcactctttagagttcgggccgaatccgcaactcggatgatcaagatgagcgctcggcgaaaactgtgcctcgtgcgaatggcgacactctcaaacctcaggtaaagcagtcggaatgagcaggctacaaaagtgcattgacaaacttgcatgcggaaagcttctcacgggcctatgactctatgttagtgcgctgtattcactcttggactttcaatgcccacctggggccacgggtagccgcgccaacggtccacgacgactttttggcgtgttatgcagctgcacggtgcttttgcagcgaattgttgaacgggcagagcgcgaaaaccttaaaaatcgagttcaggcacaagcacttttgtactaccactttactatgagccctagcaccttcatatgggcccatatggaccatccacatatcccattcggcgcctctcattggccgatcagatcccgatgcttgcgcatgctcgtcgactagtgcaagaatggtccgtaggcagtgccgccggtatggttggcctcgccagagcaagggctttcgtccgagccgcttgaatcgctcgtccggccaaattcatcaatcggccagattcgccatttgcaaaggcccctccctttggagaacgggtcgattccgctacccacatagtgaaaatcgccaatcgctgaaaggactgcctcacgcccttctcggcactttgaaacctggaggttactaaggtggaatgagctggagccaccatgctgattagtatggtcgccttttaaagtttgggtcagatgacgatatcttgctatgaaggagggtgctagcgtactctcgggctcgcgatgcctacctggcgccctcacaggcaacgccaggcaacgccaggcactcaaagcgatccgccacgactctttggcgcgtcgcacggtgtttctgcagcgttttacttcagtgtcacagtgcaaaagtgcaaaaacctaaaaaaaaaagaatccagttaccgcaggccatatacttttcacagtgcacttttctataagagccctaacaccttcctatggcccatagcacccatagcatcaccctcatccgcgcctctcattggccgatcagacctcggttcttgcgcatgctcgtcgactagtgcaaacatcgtcctctggcggtgctgccggtatcgttggcctcgccagagcaagggctttcgtccgagccgcttgtatcgctcgtccggccaaattcacaaatcggccggattcgccatgatcaaaggtccctcatcttggcaaacgggtcgattcggctactcatggcgtcaagatctccaatcgtcatctcgactgcctcacgccattctccacactctgaaacctcgatccgaatgcatgaccaagatcattctccaacattctcgttagtcaagtcgccgtttgaagttggggtgagacgacgctagatcgatatcattgagagggttggagtactctagggctcgcgatgcctgcctggcgccctcgaaggcaacaccaggcactcaatgcgatccgcaaggactcgttagcgcgtcgcacggtgtttctgcagcgttttatttcagtgtcacagcgcaaaaaccttaaaccaagtagcgtccagggtaccagcgcttctatcggggctggttcttgcaaatggtcgttgccggtgcaaaaacaatgataatttgatgctgctggtagggttggctcctcccgagcgagcgctttgtcccatgcgcttaatatacacattgtaaaagtttccgtgaattgggtcctattcgcacccgttcatcgtctttctgcctttgatcagcgctggtttttgcaaatggtcgttgccggtgcaaaaacaatgataattcgatgctgctggtacggttggcttctcctgagcgagcgctttctcccacgggctttatatacacattgtaaaagtttccgtgaattttggtccttttcgcacccattcatcacctttctgcctttgaggagcagctcgattctgcaacttggatggtcacgatgagcaatcgctgaaaacagtgcctcacgatgttcagcacactctcaaaggtcgggaaacgtgtttagaatgattagacgcggagtatcgcattagccaaactcgcttccgatagcagcgcacaagtggttttactgtatggtggagcgctgcgaggaagctctagaaccttgaatggctacttggcgccttggggagcagcaccaatggtccacgacgactctttggtgcaatatacaggctgcacggtggtatttgcagcgaacgggcagagtgacttaggcacacttttgaaccatgacctcggtattttcaaatggctcatatataccatacatatgtcccatccgacagtgtataattttgtataaaccgatgtataatccattatatctcgatgctaccggtacggatggcctctccagagcgagggctttcatcctagccgtggccataatcattctccaaaatttggattagcaaagtcgtcttcgcaagatgggtcagctgccgctagatctagcgctatcaataagagtgcataaggattcttgggctctcgatggcagtttggctttgagcagcggtgccaacggttcgcaacgatgctttggcgcaatatacagcctgcacggtgcttttcttttgcagcgaattgttgaacgggcagagcgcgaaaaccttaaaaatccaatgcaggctaccagcagttttgtactatggcccctactatgccctctgtattttcacatggcccatataggccatccatataccccatctggcacctctcattggccgatcagggccaggtcttgcaaatggtcttcaacgttgtataaacggtgtataaacccattatatttcaatgctgctggtgctgttggcctcttcagagcgtgcgctttcgaccgagctgcttgaatcgcaaatataataggtttcgtgaatgcgcaagattcacggtcgtgaatcgaccttttctctttggagttcgggtcgaatccgcaactcggatgatcaagatgagcgatcggcgaaaactgtgcctcgcgcgaatggcgacactctcaaacctcaggtaaagcagtcggaatgagcagacctcaaaaagtgctttagcaaacttgcatgcggaacgcttcgcactggcctatgactctatgtttggtgcgctgtattcgctcttgggctttcaatgcccacctggggccacgggtagccgcgccaacggtccacgacgactctctggcgtgttatacagcctgcacggtgcttttgcagcgaattgctgaacgggcagggcgcgataacccaaaaatatgaattcaggcacgagcactactaggacttcactatgagccctagcaccctcatattggcccatatgcaccatacacataccccatctgacgcttctcattggccgatatgggccagctcttgcaaatggtcgtcaaaagtgtataaacggtgtataaacccattatatttcgatgccgccggtatggttggcctctccagagcgagggctttcgtcctagccgcctcatttcaaaatatattagatttcgtgaattcgcaacattcgcgctcgtcgattgaccttccctcttcaatgaccaggtcgaatccgcaactcagatggtcaagaggagcaatcgcaagaagctgtgcctgacgtgagtcagcacactctcgaacctcgaggacagtggatggaatgaagggcgccataaagttcaccagcaaagtcgcgtacgaaagtggtgtacaggtgtctcaatatatatggcttctagtgagtgcagcggagactctttttggaccggtcttgggtacctggtgcggctgggtgccagcgccaggcaccaacgcgatccaaggggcctgttgtgcgtgctgcgtggtgtttatacagcaatgtatgtactccattgacacagttatacaaaccgtttggaaatcgatgacaaatacgagcgcacttttccactgcggcccaatctgtgtactattcttacgcctaactggcatccacctagactctgacatgcgcgtgcgtgcatagcgtgacggaccccataaaaacatgcaggcattagatcgacgatgatacagtctttgatacgtcgaccaccgggcgctaggtggattcaagcctcaatatgtcgcagcatttagcaaaacttttattcatgatccatcacccatctgctgacattgtaagaggtcagcccgcagcagagcctgattgatagaaggtctagcggcagcaaggacatgactacaatggcgagtagtggggaggagggggcgagggaggcgactcacaatatgagcaccacctgttgatggtggagcgggggcgtgctggagataatgaggtttgaacaggggcggcagcggtacctccgaccaacgcgggagtgatagcatgagttccaagaagtctgttcgcagcgttggcatgaatcgcaagaacgctgtttgcaaaaatggcattcatcgtaagaagaccgctcgcaagaagactatccgcgagaagactgctcgcaagaagtctggccgcagttatggcatgcatttcaagaagactgctcgcaagaagactatccgcaagaagactgtccgcaagaagactgtccgcaagaagactgtccacaaaaaaactgtccacaagaacactgtgcgcaagaaaactgtgcgcaagaaaattgtgcgcagtgttgttagtggcagcaatgataccgagcgcgtttgcggcagggtaaatgccaacgggtgctgcggcaacctctacagctgcgacgtgggcatcggccacttttgcagccgcgacttgggcatcggtaccagtggcgctatcagcaccaccaacaaacagagctgcagattgggcagcgagtccccttctgttggccgcttgagggtttcgccgccaaaagcgggggagacgccatgccaagcgcgaaaaaagcaccctgcgcgccgacggggctgagcgtttgtagagtccatgctgttgaggggagatgagagagaaagaggacgtagggttactgttaggttcgtgaaatgagagcgaggaaaaaaacagataggaggtgcttttgtagtcttctcccatttcgatgggatcaccacaaagcaaacggctatcagtcagcgaactgtcagtatacgaagctcatgcgagcaaaaaagtcatttttcgagtggtaaacagagtgtaactgcagtgactgttccttcttcatagaacaggggtcgcgttcgagccaacgcacgacgtccggacaacgactagaattcagacccaatggggcaaacaaaagtgcacgcaaaagtgcacgacgtacacgcgacgaggtactggttatgggaaggatttataatagactatatatgatagaccaacgcgttggcaggggggatatcgaacaagagacgagaaggggaggagagcgagagcgagtgaagagaggagaaggagaaaaggagagcgagaaggaaaaaaaaggcaggtagtaaaatctatgaccagtcatcatatcgtcgcgaatgccattgagatgcatacgaatcaccatgcaacggctctggcagctgcccatcagcctcttcctcctccttcttcttcttcttggacgcctcctcatctacggccctctcctccttcttgcgtgccgtcctgcgtgcctcactcctgttgtcaccatcaccattctgactcttgtgaccgccaatgagatccctggactttgtcaatgcctgtgaagacgtactgttctcggtccgatactgcgacggcatctctggcatcggtggctgctgctgctctccaccctccgtcggtggcatggctccattgccccatccagatccaaagaacgtcgacagtcgactcgacaaggaggtattcgacgcccgatgattcaacctcctggcctcgttctgctgcctttgttgctgttgccgttgctgatgatgcctcctgtaactggagggtgtgaaccccaactcttcatcatcatcatcaccaccagcatcctgcgcgccgccatgcccgacatctcttcccatgccgagtgcggacgatgaccggaactgagacgcaatgggcgtgacaaacgccggcttgggttgttggatcatcactcggtcttgctgctcctgtgtaaggctttctggatggacggtctgacgacgtttgatctgcttgctaccgcccatgccaatcttcatgtcgaactcctcctccgacatcatattggatcctccgacgatcgtctcgccctgcgcccaaccatcgtcctcgccccaccaccacagtccgcgctcaatcgtcccgcagacaatgacaacggagatggggatccagaggatgaacacaatcacatccagaacaatcgctgtgttcacgccccggcattgagccgtgtaaccgggttggttggagagtcgaccggcgatgcaatcggtcctggcaccccggtcgctgtccgcggcgaggaccatccagctgagaaagttgaggagggtcaagatgaccgagacgacgatggtcgtggtctgagtcgctggatggttgatgatccgtggcaggagggcacgctggctctgacggatgaggaacgggcagagtgactgccagatggctgatagggacgttccaatggtggcgaccaggactatgatggagacaaagttgaaatgcaatatcgagaaaaatgttagatgattttaccaacggtgatttgttgtttagtcaactatctgaacgagctgccagagccatgatggtggaaaagtggtgaacaatatacatggaaatataaataaataagagctactttttttttttttttttgtgctttgttcgataggccatggcgatgattatgacatatggtatttccctccgagatttgttgaattttgtcgatatttagcgccgatcttgacccctccccctcttctccggttcaggttataagtacgattgattgtcgaccatcgcctcaatatatgtagccgcccacattatgagaaacgggggtggtaaaaaacaaatatgagggtggccaaagtgacggagagggtacttacacatggtataggcaggatcgctgaaagctacctcgtacttgttcctatttggaccaatgtatccatcggattgtatcatggattagatacgcgaacgcaagcagaacaacaacatcaacaatagcaacaacaatagcaacattcataattgacaatcaaataagcagccgcatatgcatgtgcgtgtatgcacgatgcacagtgtccaggcaccgcattccagccctttctctcactctctctctttctcttcgctccccctctttcgggccaatcgcccgttagcaccttgaaaaatgaaaaaaaatagaaatagtcgattttgggtgcgtcgttacctgaacgcatacgctggcatgagagccagccaggacatggtcccaaagagcgcgagcagtccccagagcagctggagccgctcgaccgttgccatccgcatcaccttcagtcggaggctcttccaccgtgttggctctgccagcggcacatttgaaaaggacatggtcgctgattttcctcgagagggttgacgggccgtggtgctctggagcgtgctcgtggggctgcctaaactattggccgaggccgagggagagatgaaggccgcgcccggcagcactggcgtcgaagtgatgttgttgtctgttttggtatccgatacgttgctgttgtggtcgacgctgtaaacgggaggcccaccacccgtgtggccagagaaagaggaggaggaggacgacgagagctggcgtcgggctgggggtggaggcgaggtggggcgcgtgaagttggtatggctgctgttcccggcgtgctgcttgtggtgcgacgagtatgcagagtacgaagacatgccaactgctaaccggtgcgcatgaactggttgggggtgagagaaagtatgtgagtgtaggtgtctttctgaatgttggaatgaccgatggcgagatccctggctactgtattaaggcgggaaggggtatataatatgcactctggggcgtgtggtggtgggaggggtcgttatgagaaattataggcgaggaataggggaacgaggaggagggcaggacggaatggcgggacgagaagagcggatttgggggggatgacggagaggatgaaggagaggaagaggatgagggcgacggagaagacggaaagaagaacaaaaagggaaggaaaggacagacgaaggacagaggaaggacagaagaaggcctgaagaaggacagaaggacagaaggacagacgacgacagcaacgacagaaagagatgaatgagccatccacaaagcaggctgggactcgaatgacctcgtctacacgcgcacgcctgctatgacagcaatgtatcacagagaacacacaacaacatgccccgcaaccgccttcctgacccgcgacgcatctgcatgcttcggtcgcccagtcggagttgcagaggaattcgcccaccgcatggtcgcatggtactccagtctaggtgggtacagcgtggatggacaggggcagggttggcaccacccaacccggtactgcccaagtacatgcagaccaccttcgaatgcacaacagaaggagacagctcttgggtttgctcgacacttatttttggcatcgcactcactagaaacacactgaggcacataagaaaaaaacgtcctgttgtccccctgtccagggctctcgacatcttggtcgaagacaaacgctctctttttctttgtctccctcgagctctcatgtcttagtgcaagtagtctggtgtctataatgctcttgtgccacaccctcttaaacaacattcaagtaatgcagcagtctccttagtcttgatcccttttcctctgatgctccacaccgacctggtgcgcagggtacttggtggtaatagtagtgcaatcttttttttctcttgtcccgggatccttcccacgaacaaaggctgtgaaaaaaaaaccccccttcatacaaaacagccgtgttgatgcttctactagtctcagactccgtgctcgcaacattgtcttgtattgattcttcgattccgtattgaagcactatatacactgttgtctgaatggcggcggtggaagcgtgtccttttgatgtttgtatgtcccccccctccaaatccggcccagtcgtctctagcagtcgcctcccgccttcgtattcaggataagtcccacgatcaatccatagagtcccaagacttctgcgaaaataagcactagcaccatggccacaaagagccttggttggtatgcatatccacggacacactataagacaaaaacaaaaaaggatcacataccaaggatgcaatcggggcgttaggaatgatgcagcaaaggggtgagagcagggatcgcatcccatggatgagcccccctctctctcccaggtactcaaacgcttccgtgctgatttgagcagaggagggcgggcacagattccgagcaagacgcgtggtacccgtgtgcgcgtatctcacttaccacgtcgcccacgattccaatggcgtatccagcaaccaatcctgtcaagccgacacacagtccagcgccaagatgcacaaagcctctattgtcatcccaaaaagtaaacatcagtcgtccatcccgcccgcgatcatctcagtcatcatcattcagaattataaggccagacgcgccgtataagatcacttacgcgtataaggagtaattactggacgacactatttgtgatatcccaaaagaaggccccaaaatacaaatgtgagaaaagacaagagaaggggggcagtgagtaaaagctgatccaggttcttccctgatactccgcactacaaagcgtcatccatccaggtccgagagacatatcgcggcatcaaagaaagggcgaggaagaaagagtagtttgatgattcggttgacatacatgatccagcaatcaagacggagatgacaagtccgtaaactgagataataccggccatgactacaggaattaatgcctaggatttaaaagaaggcaaaaaaaaaaaaaatccacgagttgagtcagctagcaaaataggggaagcaaggggacatcgttttcagatcgacagcacccccacagcaaacagaagggggggggggagggagggagagatagagacccactcaccttcatcatgagctctggacggaaggttcccataccggcgataccgatgccagacttgaatgtgccgtatccagctcccatgcctgaaagaagaccattgtcgattttttttgtacggggatgcaagagaaaagtgtggtcagccagctgaggcgatagtcaggggttcaggtcgtgacctaacccaaaaaaaaaaatattcatttccatactgctgaagaccatctgttgaagaggcagtgacagagagagagagagagagaaggagaaagagaaccaaagctggtgtttagtgtcttggcatggcctgcccgcaacgcgggtacagcgacttgtttaccccatgccgcaaaagtcaaacgtacagcgctggccacacccatcaggccaaagaatggcgcaaacggagggcaaaagtcggaagcgataggtggtagggtggccatggcgttgctctaaagtcctgcaatgaattagactaggagagacagggcgaagagagagtcgaggatgcacaggaagcggaggaggagagggaagggattggagaaagctgtggtggtggatggtcaatgaatcaatcctctgagcacatcacattcgatagctcaatgcacgtgactaaagtgacgtaactcgacgcgacgcgagcaatcgcgtttcttttactgttggaatttgtagatgtttttcatataccagtcgcccttgaaggccttggtctggctcgcaatcatggtcatccgctcaatcagcggcgcacgcaccttctcgcttcgctcccgaatcgacttgcgatcgtgcctcccgcgccgcgagaaccggtcagcacacggtaccttcttcaggtgcaacctgcctgtccactcgtcatactcgtacgcgtcgtaaaagttgaagctcgccggctttccattcgtcctgttcctgcgggtcctgcccttattgcagctatcatcaccgtcgccagcagccctcgcttgcttgcccaagtcaaagacgggatctagaaccgagtctgtgtccgaaccagcgtccgattccgcatccgagtcagaatccgcatccgaaagggacgctgacatctccacccaaggctgatccacttccagcgcgaccatacgtcccgtctcatcgtaatgttgctgtctcaacccctgttgttgttgctgttgttgttgtgatggctgtggatgcgccatcgtctgttgccgcaacatttcagccttgactgcaagtgcaacagctcgcgcctccacctgctccgagaccgtcactttcagtgtacccatgtggcccgagaccctcaggaaccggtaccccaaacgttccaccgacactttgctccgatagcctcctgatgaacttgacgtgcccgaggaggatgacgcatccgagatgtagctctgggtcgacacgaaggatgatcgctcaacaccccacgggcgctgagacagacctgggccggacgtgcatggcacaagagtcctcatcgtcgtgtcgtctccatctccagggaggtgcccaatcatctgaattccaaccttgtcccgccaccaacgcagctctgcaacgtcctcgatgaccgtccactgaacaagaggcgatcggtaaaacgatccaccgctgtccagctcgagcttttgaagtcgctgatggactgtggcgaagaggtgttggaacttgaggcctgcctggttgccctgtcgccgaatcggtggtgcgctgtaagggttggaggaggtcgacattgtgctcgaggaagtggccggcgatggcggtgagaactctgtgggcgatgaagtcacacccatgtcgctggaggactgtcgtctcctcagccctgcagttttctcgacctgagagctgaactgggccacagctatcgtgtgagcctctgaatcaggggcttcggcacttggcggacttgtcgaaagcgtcagtgacttgctcttgtattctgcaggattgtagggcgtaacaatcgaacgagcggtcttggtcgacgacggtgaagaacctgttggggtcgaaggagacctgatagcggctacggttttggatgcaaacccaggaagcactcgctgcttcttcttcacgctgaaataatccgtaccatcgccattgctcgcgctcatgggtgttgaggacgtcggactgacgcactggttggactgatccaaatccttgtcccggccgctgatttcttgagaagatgctcccgaggacgatgagccataaaagctgggcgtcgccactgcgatcgatcgctgcaacagcagctttgcgcctaaagtaaaactgctagccgattttgtcagagtcttgtactcgctgtacgtcaggagcgtgtgccgcccgaggcgggtcacgaacaccctgcggctgccagacccgtgtcccgaagaagacacactgcttctgcccttggtcgaattgtcgtggcggggcgtgcggttcatctctggtccactgtgtgttgtcactgaagtgatgcgccgtgtgtcgttgtggcctggttgttgatgaagtgctggcacagaggcgctggaggccataaggtccaaacgtggctgctgatgggcagctaatgggtccatgaacgtgtacttcttggaagcctcgacaaagtgcaattcgttgtcctccatgacatcaaacttgaatttgagtccattcttgctgtagatgtggagttgagaaaccgcctgcttcttgaactgctgtggaccgtctgccggtgttgcttccgctagagaatcgttgccattaggaccagaggaggaccgagatgcagggccggtgcttgcctttcgagcgggcaaggaggatcgcctttgcagggccttgaatcgctttttggacattaggttcataccatccaggcggcctgtcgtatacacgcccctcctccgttccagggtcttcgtgtccactgctttgtctctcgaggtgtactcaccatcgctatccggaaacagtggctgctcctgggtggaggcgcgagacgatgccgtgctttcgcgagacggccccacgaggctgccccatccgtcagatttcttgaggctgtcgtaggcatctatgacctcttgcaagtttaggctttgcagactggtgttgtggctggacatgttcaagagggcttccaggttctcatcctcgtcactgtcgcctgcggacgccttgcgctgcttcttgcgcatttgtagcagcagctgtctcttcagcctttgcgagaccgagaccgcatcgatagagtccagaaatgaggtagagggcgacgcagaggaaggggacgatgttggagatgcactaatctcggcgtccagcactgaggacgagacgcccaggacagaagtgtcctgtcgcttgaacttcttgaccaacttgaacaggaagaacccatttgggccatcttgatccaagtccagacggaacagttcaaagacctgctcttttgtcaagatctgatgagattcaagccgctgccgatggatcccatcttggtgccaagcccatggtgcattcttgacttgcatcgaccatttgcaccccttggatggcttatgcggcggaagaagcgagctggatggaacagttgaaaagcctgaggtatcctcgaccatgcccatctttccattggatacccctatggatttatcgagggcaagcgcatctgatcgggcagcaacttgatcctcggtcaaaagtcggctgtggactggccctgtatgtggcgaaaaagcctgctcctgaagatgggaatggtcgtggtgtctttcagtgaactccaagacaatgtcgtggcgcttctctgcagcgggtatagcatgaatgtgcttggtaggtcgagacggtgatttattctcgcaactggcatttttgacagagcaggaggtcgtatcaatctgcggcaactgcactgagccctcggcgtcgcgtggaaagctgaagcgagaaacgcccgtcgggagcatcggtagcgcacagggcatgttcgatcctgtcgtacgggtctttactgaaggatgaatagcaccatgttgactctccacgcggacatgctgagctctggcattgccggcgatggttggcgaaggaggcggtgaagggaatgacttttgacgctctcccgctacaccgagcgcgtgtgtggatgtggtggaagtcgctcggttgatgagtgtgtcattgttgtccttcctggcacgtcgagtcggaggcgacgatggaggagatacgggtggcacgacttgtgtcgctggttggcgctcgacagatctgcgggttggtgttctgtctgcgtccggaatgctgggccgccttgaagacagcggtgcacagttttcctttccgttgctagatcttctcaagaggggcgaggccgacgtggaggagccggtcgaagtcgaggaacgctgagctgcgctggaatttgtattgctgccagagttgacagcttcatgagtaaagtaaccaggatgtgagaatgatgatgaggctccggacgagaacgtcgagagttcggaggctatagaggacgcgtccgtactgatatcggatagcgcaagactggggcgatggggtgactgcaagatagctgaatggatggcgggcaccaggtggtctggagacatgggcgtctgagcgacgaccatgggcagctgctccgaggtcgacggtgggatggccatgtagatgatcgagttggttgccctccttagagactttgtccagctcctgtgcttgcggtcggctgtggtcgatgctgccgagacgttgctccctggcagttgcgggtcctgtgggctgacttctgaatcttgcttcaccattatgtcttttgagcttgaacctgacgcgtcgactgcgcttttcgaggcggggctatagggcaagaaaattggatacgttagatctcaaagtattcttgtgagcctcttgttcaagaggatagctccgatcctactcgcatacctaaggctagtattcgcgaaccgacacggcttgaagtgaaggctacgagactacggagtagtttcaacggtttttctaaagggtcgaggagcaatttggtggtccgggtcaacatggttaaggagggatcatggaaagaggtgttcaatttgtgaatgcaaaagagactaataagcctgaacaagtgacatgaggggatgctgatgataagtctgagggccatgaggaatgaaggatggcgaggtgggatggatgaccttacctgtgctggagttgaggcaattggctgtgctgagcagtgccgtgcagggaaggaagctcgacgggggttgaaaaggggtcagggacgaagggaggcgtgtggagaagctgctcgcgatcgagctatcacgagcaggggcaggactggaaagctcagagcgggagaagaacaaggcgcgggagagggaaagacgagagtgggaggaggcagagagaaaagcgtgaagagagtgagagcgagagagtgagcgagagagagagtgagtggaggagcgagaaagagaaggatggatgggagaaggaggggcagaggaaagaagacgaagagaacaaaacgacgacacagaagacagaagtgagaataagtgacagaggagagggaagaagaaggctgttgcgcagggggatggacaggtggattggagagacgtgggggcgagggctgtccgctgcactctcgttccatccatcagttgttgttgttggtcaatctctccacatccacacccacacccacagacagcagactgcagactagtctacagcacatgcatccaccactcacgccacacattctttgcgctctcatgtcaggcacaacacaacacaacacagcgacagacacatgcacaacattccccccaaagtgcacaacgccatttttctggatgacaatttcgatatccatttgcttgcttgcctgtctgcgtgtacatgctcacaactgagctcgccttctctcatagtgatctctatcgcgctgtctcgcatgctgtcccctagactggtcaataccttggtggatcaatttgcctcacctggtgagaaataagtagcaaccgcgagaaaggtgatgacacaaaaagatctcctctccactgatccaatagacgtctggcataatgttggtcgatgctcgctctctccactcggaaacaaacacacacgccaaagtataaaccgagaaaaaaaatgaactattttctcatctctccacaaattcacccaactttttgcacaaaactcggcaataaacattcggagctgtccaccttttttccctttatgttgcatacataatgaaagaaaaaaaattgtctgcataatctatgaaggtaggtgtgtaaagtgcgcaagacggacacaacagtacgcacgcgccttgctacaaaaaagcagcaaaacagagcgtcgaaaccaatttgcagtacaagatgtaagcatatgcgggggacgagaggtatatataatcaggataaagagacacacatacacacacaactcgatgctgcgcttctgttaagagagtgagtattttagacgtgcagcggtactcccactctttgtaaaggccaaaaaagatgagatctgtctagctgtctgcaagcaacatctggattctcaggagcagcattgcagtgctctcctaggtatcggctggccatgaatgtcagctatatgtctcgatggcatcccgtaacagagactctcttgtcctcagtagttgcgtcgcgaaagctcgagcgccataagcagcgcgttctcctcgaatgactataagaaaaaaggcagtcacaagttttcgtttttctcaggttaggaagatgcattgaccatcgttctcgttcatgtcgtctttctcgactcctcctcctctccctggccactatccttacgtttcagcaacagcaagtctctcgaagcgtcatctcgccgaagcactgcaggaaatttgagcggaacaaagttgcgaatgccatccttgacagcaattgcgactcggtatgcgctcggctttgagctatccgcactgggcactggtcgaactatgcaaatgacatctagggacattggaccaagcgctttagttcgtcaaaacagtctgttctcctgagagcagcgcatcggctgttttcatcgaacggtaatcacatacggttttggcgtgatcctacgctgctcaaatcgaaatgctcttcgtcgtcgcgctcctgaaatacaataacgacctgttgtaaatatgccatagttgtaggaaacaagaatgtcaaaaacagcgcggaaacatttctcatacaactgaatccttgaaaaaaaaagaagcttttacgttacaatgtcatttccaatgaagcgccggcgctcgacttgctggcggtccgctggattgaacggcagcaaaggcgcacaatgaaacatgatttgatagtcattccactgtgtgaatattgatgtctcgccggtggtgtcgcctagaaacgaaccccagtaatccaaatcagcgcaaggagccttccgcaatggtttcatatggtctatggcgtagtcgtgctctaccttaccaataacatccagcccagcacgatatcctttccatccacagagtcggatcggttctccaagccattgtaagaagtctctaaagtcaggcgtgcaagtatcttccgttcagcatggagttgaagcaatcaagaagaacagagtttgcagacatggatcgggatggtagaagggttagaatgcagggtcgagttaagtacaaagtacgagaattgtcaaaggcaatttttgtttcttaccacaaggatttgcaagaccctcttgctcctgtgtctgtcccggtagcagctgaaatacaccaaacttgtagcatcgtatgatctgccgttcttccatccggataagctcctgcggcagctctgggtgctggcacaactctagtgcatgaatcggtatggcggggcagatctgctccagtatcgagaggtacggcactccaaatagtttacgaaaccaggggattgtcagggccgacagtggatattctattctctcgctaccctagaaggacaaaaaaaacaacgaaggcgttagagaagaggttaggctgggtgttacagaacacaaggctgcaatacattgcccattcttttgcgacaacagcgatgcgcacccgcgtggtcctgacgagaattctaacagagtcgtcctggtccactcgcatcgagatgatgatgggtccttgcacagttgtggcggccacatagttgatatgagcttaaagaaacgatgaagtttgattctttagaaggaaagtcttgtgcatacgagtatgtcagtctcttcaaattgagcttcttctggcttcatcttctaccttggtcaagaaaatgcgtccgatagaattcgaggtctcgctctcggtcttgaaggagcgctgaatggttgaacagctgcttgctggccgatgtggagcatcccgagtctgcgacgagttctggggcgaaaggggaggaggaggctgggtgttttgtcgtgtaggcggatagatagcggaagtcagagtgcgacggagcagccacggtcatcccgaagaatatagcgacccgaggaggagcatcccaatggcgacaaagatccctgcgagagcttgacgagggcaagagtttgaagagcggtggagaggagggctgactgttatgctccgaggaggttgtggtggaggttgacggttactgaggacagggtagtcgggcgaagggggagggaagggaggcgaaggagcagagaaagggcaacaagagaataaagagggtaaagaggcagggcagggcaacagcacggtagacaaaaaaaacaacggaacaaagagtggagcgaaggagaggaggaggaggagagcgagtgcagaggagtgcgctggtctgtggaggagcaagaggacgagaacagagcgagagcataaagggaacgagagcagagcgacggaggcacggcgaagacgagcaaacgaacgaaaagaaagaaagaggacaaacagagaaagcgaggccgtggtggaacgatcaaatgaacacgcaatgcattccgatttctaacagcgggatgtcaggggtcgcccgtggaagagattatgcgcccgaaggtgcttcgtcctccaacgacagaatccacacgaggccacccatcgcgcacgctcggcctcgttgcctgagcggtaaagaagggggtccgcgggagcgagtgccttgctgaacgagtccttggcaggatgcagacaaagaacgacctcactcgacagacagagaacgagagtgtggaaaaaaaaaaaaaagacaagacagaacaaggctcgagatctctgtgctagcccattcgtgctcgagccctttgtcatgcgtagatgcaatgctaacgtgctacagacatgcactggagcgatgcagtcatgcagcactctatgcgagccctcaggctagatataggcttcaggaagccacgtctcgcttcatttcgtgagaggagagtgacgctggagtgtctgccgcttgtctcaaggccattccaagagacgagcgactcatgcaacaatgcgctctcttgggatgttgaggatgggtgcgcacggctcaacctcattggtgtcaggagcaaagaccgcatggcgggtgtacagcatgatgctgctcaccagcaggcatgcacgcaagccaaaggctcccttggccatcgccttggcctgtaggaacgtgctccttgcgtaagtggcggcgaggtacgactgctggaacctaagcgcgttcaaatatagatttgcagctgaaaaaaagagcgcccacgccgccgattgtactgatacatgtcgtgacatgaagtgaagtagctctttgggtacatgacgccatggaagctgagcggtatgattccagcgccatgtgcttcatggtcccaggtctgctgctgcgaatgcagactagaagcaaggcgttcttgagccagggtacgagggtactgtacttgtactgcacatgtactgcacatctctgctcaatgttgcactttcgccctgttgttcatcctttctgagtggtgcttcaatatattaggcaatagagttcatgtctttattgcgtttgtctcgattttttttttatggccccccaacagcccgtgggttattttgttgttgttttcgctcgtcttttgtttccttcccatccatccatctcctcgctctcgcctcaccgctgactcctccttccccgccttgcacaggacactgcctcgccatccaccgcggatgccccatcttcgactgctcacccagccacgactcctcctcacgaccacgcccacactcacccacatcgtcctgcacgaccgtcgacagcctcgttgttgtcgctgaggtaccctcgagaacctctcccctcccctcgctcacgttcactgtacacacacacactctctctctctctctctctctctctctctctttttttctcggccaccagcttcctcgtcgctttttgtcgtctctcctcctcgtccgtccctcgaccatacaatccgctactggcatcgttctggacaagctaagcttaccgaagatcggctatctatcgaacccccttttccactcgacaacaacaaacaaactcgacgagacaaggtgtgtgtgtaggttggctgcagacgcccaccgtaattaatttaaattagtttgaccactggtgcgccagagaaggaaaaggagcggctgggcaaaggggtgaaggaaaatagtagcagcgggttgattcccacccaacgtcagctacagcaacagctacagcatcaagggtagaggaggaagtgcccgttcttattaacgaaaagggttatcttcgccaggaatgagcgggtatgtacgtcctgtacctggcaaaagtagggggcaaaagagggtacaataatagagcgtacaatataggaacggtacagtacggcggacaaggtatgcggatgtgtagctgggctattgagtgaccacatcatcgacgtttctctttcaggctccgtgcaacaagttgaacgcgcgatgaaggctaccggtttgttgggtgcgagcttgtgtataaggatacccggtgcataccctatccgaaccctcctcacgatcctctacccccttgcccaacttctgcaccatgcgccatgcaccatgcagatgggaagagctcttctctcgcgcgttgcaacaaggcacccccgacgcaatgtttcaatttagtagtgtgttggaaagttctcaaattatgtgagcatgatgcactgcatggggtggtgctggctggctctcgcatggttgcagcgaggtgggtgggcgaggacacactgccacgatccactttgcccttcgtttcttctcgagagcattttactgacccaggcttctgcaagggaatcttaggttcagccgttgcagccctcccgatatctcttcaaagatcacggcccacacaaacaaacgatgcatgttctgtctccaaagcgcctcgcgtcttcggcgctgcttctgtccctgtcgaccgtgtgcgccaacatcagttttgtaagaatcccgccgacgatcctgcagcccggcgagactatagagttgcaatggagcattgtcactcccacggcaggcacgctagacaccacggagccatttaatttgcagctgcgtgctttgagcgggcagcgatatgatctcaacaagctgatccctcaaacggcggccaaactcagagttgtcattcccaaagaggccacaggcggtctggtaagtttacgtgtccttcagctcagcttaatcaagccaggcgatggggcgtaagcattgaaaagtacgatacgtggcctccgtcctcacgcatatcttcttcccgggtcaacagcatagcttctatgcagactacacaggacccattaatgtcaagcccacagcctccaaccagttcaacatcaccggtgccatcgtcgtgaccaccaccgtcggacccacctcaactctcggccctaccgcctcgattaccgccccgcatggaaagagcacgccgtcgagccaaactcctgattcgcaagcggccactgatgagggtctttctggcggcgcaattggtggcatcattgccggcgtggtcatctttttgctgctcatcgctctaatcttctttgcgcgacaccgccgcctagagcgtgagcgcaaccagcacacgcgtcttgacgactcaaaggagtcctacagcgagactgcgacggctcgctctggcccgccttccgccaagggtggcgaaggcatggtctccgtgccgctgtctgccccagcgcctgtgtatccatccccgttctcagacgagcccaagccgcagccacagcacccgatgaatcagatgcagcatgtcaatggcagtagtaatcccttcgatgcgcctgaggaccggacaagaggcctccctcccgtaggggccatggccatgggggcagtcggctctccaaggtctctgtcgcctcgccagcaacatcaaccttaccaacctcctcagtttgaacagcagcctccgcgtccccaacagcagcagtatggagtgccgttgcagcaacgcagtcagagtccatttcagcagggcagcagcggccgcgactcgttagactcggaacctgaatctgcttatgatccggcacatgctcgtatgatgcctcatcctgcgggaggcaatggcaacggacctattgtgcgcaacaactccaacccaatgatgcaacgtggaggcccaccaggcccaggatcccagttggcatactcgccctcgggacgctctgtcatgagtgacgcacagaacacgtcccactctcatcaacggcagcaaaaccccttccaggaccgggaactcttggctgcagcggcgggtggtgcggcggtgggtgcgatcgcagccgccaaccgccgtcagggatcgccagctcccaactctcctgcacaggcgcaccgtcatctgacgcccatgaatgattctcgagttcaaacacccttgcctggccaagggagccctttacctcgctcaaaagaaatcgagatgcagcccttggatgtccagcagcatcagtatgaccagcagcagcggatgttgcagcgtcaacaacagcaaagacagcaggcagaagcacaggtgcaggcgggacagcagcagcagccattagttcaacccattcaacagaccccgcttcctcccacccccgtcccggccccggccccagccccggctgcagcatcgcatcccttcaaccctacgctttacgatgacaaaaccgagattgatgacgatggcatgcccgtctataacggctaccgcgacaccattttcggagcctattctcagccacttgaggggagtgatgacgacgacgacgacgacgagacagctgtgcctattgttcctacattggccctggtttcagcaggcggcgatgcacagaagcagcaacaggccgctgctgacacccaagcatcgtcgagtggcgctggagcaggagttcagcgtaaaaagtcggtcaagttcacaggtgtgcccctgtctggttcgatcgatgtccccgtttcaacctcgcatcagcaccagcagcagttgtatcacagcgatgatgatgatgatgatgatgttgacgacgaggatgaggaagacgggatggaggatgaggatgaggatgatatcaagatgaggctcatgcaaactgaggtcccaagtcctgcatcggctcatgcccgccctccgttcatcaacaccactcccggctcgtccccctcagctcaacatcaccaggcgagtgtgttgtcccccgtccgatctccggatcaagcttatccttcctcatcaggcaactaccaccagtctcatggcaatcaccatgccgtcggtggtggtttccccgttccagcgcccatcccagcctccgctcccaagcaacaccaacagcagcagcagcatcagcagcagcagtctagcagccacgcgacaggatcatcgtcaccgagtctgaatacggcttcatcgtcctttggaaacgggttctatgaggatgtgctcgcagcggtggacaagaactccaagagcctgccttcgtcctcaacgactgcagcgaacaatgcggccccactgcagaagcaccagcctgtgagggttgatcaagaggtctttggggctccctcaccccgggtctcggctgcagtcgccactccagcacatcaacagcatctgaagaatggtcagcagccatcgatgccaaagccatatcagcaaccaccgcagcagcagcagcatggaggcgagcacaatgcagggttctatgaatcgccactgttgtaaaaaaaaaaaaaaaaggacagacgatcccgattttcctcctcgcatgttatagacgttgtttcacttgtttttttgttccatagaaagcatgatactcagatctgtcgcgcgtccttttggtgactctccgtccaaccccagtcgattgtcattcatcccatatagaagaaaaaaagaggctacttagttttctattttgctggctcggctctacttttcggcggtgcccgaggaaggttatctagagcacctctaactataccattcagtcaacagacgtgaatagagtacaaaagtgaagttttatcgagcaacgctcacggttccgccttttgcctcatgtggcactgttcaggaaacggggtggggggagaactttcacaacgacacgcgccgtcctccagcaaaagcgctccgttatggtttttgttacagtatttgaaaatgagaggaaggaggatttggtccgcgagcgtcattttttttttttagctcatgatcctcgtgtggcatgcgtactcttccggaagagattgaaccgatgttctttccgtttcttcatctccttttgctgttcccggtactgtccttctgcctggtgttcaaagaagctgggttcaaacagagccagatggcccttgatccgttggacatagccctcgacagcgataccgtttccaaagctttccagaaacggtttgtgacagtaaggttccgtgttggcgtccagttccatgagtcgttcccaaaagtcctgagcgcctccggacgggtaagggaagcggacatagtccatggcaaagacgaccatgggcggcgttggcagcttgaaattctcttggatctcacgggcccaggccatgagcggcactctggactgggtggccggtaagagttcgggggtggcgtgggtgaaaacgacgatgagttttgaccagaacgcgggcgtcaagaggctctggtaggtttgaagcgtttgatgaaacgtgttgtcatatctataaattgacgtttcggcattcccgccctcgaaacagtgttagatcgattcttttatgctttgtatttgaatcgcttgaaaagaaaacgaacagtggaaagaaaaaaaaaaacgcccaaagcaacagcccattatcaaaggcacatagactcacctgtaccgcgtgcacttgacgacaaagagaaatgcgtccacgcctgctgcgactttggtcagaaggacgccgagttcgttgacgcgatgtggatcatgcagctttccattgaaggagggagtatcgacacagtgcataaccgggttggaggggatgttgagaaagtggttggttgctttatccacatgctgagttacttcctaaattcccggcaagaaaaaaaaaaagggtagagttgagtaaaaagggggtgagtgtatgtgcctgatgtacagcaaaggtgtaccaaaaggcaagacaagcgggaatagggctgacaaggcaggagggacgatattcgttgtgaacaaggggggcaatagagaagaggaggaggagaggttcatttacactgacagaggccttggccagaaacatttctcggcctagaatggcatttagcaatgtgctctttcctaaggttcacaagggaatcggaaagtgcggcgtcaggagcaatgttcatagcctcgagatgacacaaaggaaattggtcgcctcatcgagagtggtttttctcggacggcatcaagagatatataccttcgccacttttgcctagggccacaatggtgaattcacgggctggaggagcactgtcggcctggttttgctgtggcggttcttgcagttgcacttgttgctgtggttgtacctgtcgctgtggttgtggttgatgtgaaggatagtgttgtgttggatgttgctgctgctgctgctggtgctgctgcgttggatagggctgctggtgctgcctgtactgctgctgctggtgctggagctgctggtgctgtggctgtgctgggtagtgctgctgactttgatgccgttggggaggaggtgcctgacccgagtacattacggagcgtctcttcagagagtgtgtgcgcgagtgaggtgtgtggcgatgggtatggacagcgacggacgggaaggctaggagggcgggatgaggagagcgaaggaggacacaggcagatgcagaagcgaggcgagacagatggaaatgaaagcagggatgaagagaaagaaagggctccgtcctgcggggcgtcttttttgcctttgtgactgactctctgcctgccaagcccaaacgtgatccacagaaaggtagcccgcatgtgcctgcgcttggctcttctcgtcttttgtctcccttttcccactcattctcacttttttgtctctctctctctctctctctctctctcacacacacacacactctctctctctcgcctctgtatatttcgctcactctccgtcactgtccttcgctcctccccatgccgcgagtcagcatcagccccatcgccgttggcaagctcagattcctcatcctcgactgcccgtccgacgccaccatcgccgcctacttgcccatcctcgacgagcacaatgtcacagacctcgtccgcatctgcgagggcagtccatacgaccccaagcccctaaacgatgctggaatccatgttcacgacgatatgtatgttgcaacacaacccaggcctcgtcttttttgtcaccgagacttgcagtcagttgtgcaggacaaggtactgacctgcaacactctcttccatccactgcaggaagtttcaggacggaacagcgcccggcaaggacattgtcgcacgctggctggacttgaacgacaaggtcttttatggctctggagagactgagaaatgcattgcggttcactgcatatcgggcattggacgagcgcctgtaagcagacaagcttttctgagtctccgggaaaatgacatcagcatgaccactcacgaccatttcttgtttgtctttggatgggataggttctggttgccatctctcttattgaaggaggcatggatccactggtaagagtcttgttttattgttgttggctttgggtgccaaatgtgtcatgagcaaaatacaaaagtttcgcctgggaaaaagaattaccaaacgacttgagcgcgctgaccatatgcaaacgttaatttcataggacgccattacgtatatccggaaagcacgacgaggcgcgcttaatcgtgtacagatcgcctttctcgacaggtaaatgatcctaacgacttttctctttggccgcaaaagtggcgtaacctcttttgaagtgagagcgtggtctaatagccttacacgcacactcgctttagctacaagaagcggaaacaaggcttcggtgcaaagaaaccgccgaataagagcgtcggtgcagtcagtagcaacagtgttggggacagcagtcagcagctcacagggtcagggtcaggatcagggacggagaaaaagaagtcgggcttcatatccaagatgtttggaaaaaagtaatatatcaacccgtagagttatacagtatgacgttacggctggagaatatccccacagttgatggcgcgatgggacgaggagatgaatgcctgaactctgctgaacacgatggctgaggaggagagggcggaataagcatgttagagatactcaactgtcagtgaccagatactttgcggaagtgcagtcgcaacacctaccacctgccagtgtgagcaagtgctcccacatattatagggcaccattctttcagggattgattctggacgtgggaactgtggcatcgaaggaacccgatcgtgtaaggggtcaccagcccttcggtgctatcatatctcagcttcagaatttagcatgaccgcagcgagctccatctcgacatggactagtgaagttgtacttgggtagctacttaccgtgacaccattatgagatgctggacgcttgcccatctaccccccccccccccccccctttttttttaccctttttgtgccattcatgagcgtgctacgcagtagtttttccatgcaaggtgtaggggtccagaacgcagtaatggcggacaggtagagagttgcagcgctaactttgtctattttttttttctgttctcaataatgttaatttgcccaatatccgccctcgaaccaattggactcgtcggaatgcaattcatctttcatatcactccttggacaaccatccaaaaaccgacctaaacgacattctgcgatccgccttctcgccgcattcacaacaacagttgctgcaacgaactcagcaggatccctgtcgagattggatttctccgcaacctaacccttctagacctgtccaaaaacagcctgacgtgcctgcccgataccatcaaataccttaccaaactcgtggacctgaagctgtcgttcaaccagctcgagaccatcccagcgggcattggaggtctgaccaagctggcggctctgtctctggacaacaaccgactcgagtccatccccgcgcaaatcggcctgatcaaaggactcgtcaacctggatctgtccgacaaccctatcacagtcctgcctgcagaggtgggcaagctgcagttcctgagacgactgaaactggaccgctgtccactggtggaggagtttgtgcactcgccattgcactcccctccctcactcctggaattggctgctagagtgattgtccgccacgatgtggccgtgcctgccatgatttcaccgcatctaaagtcttacctcaagagcgcgcgcaagtgcacattctgcgagggaccctactttgatgcatcggtcaagcgtggcaagatgattgagaagaacgatgcctttattccgctcgagtacaccctctgccagccgcactggaacactgaactagaaagggtcaagttgttgttctgtcagcgacctatcacagcgccaccactcaaaacatctggtccatctggagcgcaaccacaacgtcctgcaggaggtggaggccagacctcaacaaagaaacaacgaccgaaatcatcctctttgaccatggcattgccaccctctggatcagagacagacgtggcaacagctggacccgggtcgcttgcagcacctccagcggacaatcaacctctccccgcggttcgtctgcgcagagcaaagaatgcccaggagggaggcgagcgagagcgaccactgtccatgtttggcaaccgtttgtcaatgctcttgaagctaaagggagagcgacgggagagaccggccacgacgttcatgacgaccactacatcgcctctatctgctgctactggtgctggtgccgcaggtacagctgcagatactgttgctgctgccacaccctcctctgctggaccaccttccagtccctcttcctcaacgacagtctctgcagccgttgatagcgcccgaccgagagccacacgttcagcgacgagtgcattcttgaagcgggccgggcgcaagttggctcgaccgctttcgttgggatcggcgttggacggacccgagctgttgaacattataccagccggttcgccacatgcgcattctggagtgcgcttggcatgaaagcattagatttttttttatacccttcctactttttcactttttttttatttcagccctcctatgtattcaccctccaaccagtccttgacaccttcatccgcgcaaagagaaacaaaacacatcatgtacatacatcgccgccactccatcctcttgcaactggcgagttgaacaagaagagggggaggaaaaaaacaagaaaatcgattcaaagtgatatccaaataaaaaaaagcgttcttgacatttttctataggtagccaactgtgttcgtattgctctaaattctgctctaaagtatttctgctcatagatttgcaaatgacatgaaggcgcgcttcctaactgaaaaagaaaagctccagcgcatgaagctcctcatactagaacggagcatatgcctatcgatttcaggcgcgtttacgaagccggttcagctctggagtggtggtagttcttaaacgctcggccttctccgtcctggcctcagctacgttctttttcttgggctctacgacggcccgaaggccacgcttgacggtgtgggccagctcaaaccatgtcttgtactctgctccaatcattgccagctcctgcagtgaatcatggaacggtgagatcgtgcacacgcagtaacacgtcgatattgccaaaactcccgcatgggatagacgctcatgatttggccaattatttgatagccaagcagtgttacatcgtccgccgattctggcgagatcctttgcttcttttatcaaacgcttgagaaatcaaataggctactggaagtggccagcgtggttcatgaatggactcttggggatgaacacccttgaaagatcgaggaaccgtatctgacacttaccaatgataagagtctcgtgctcgctagcctctatatgactctcgatttgctgtcctttttgctgccatggatagctgggaccgcatggctcttgaagtcgtagaatgactgatcttcgtatcatacgcataatcctcgtatttctgcccagagacccccgctctatgtatcccaaacaagatcacaggcatcagttacgctatgctgattgcgggcaaagcaaagctaaatacgacccttattacgccggctaagaatgagcgacgaagtacaaaaaaaaaggaagccttgctctacgcatccgtgccgcgtactaaataggatgcgctaagaacgagaaagtcccccctcgaactggctataaaattctcgtgctgactgcaaaaaacgaagtcggaggctgcttggagagcgcgcaccgtttttccctcctcgctgttccaaacggttctacccgtcgtgcgcagctaagctttcaaaaaaaaacaaagaggccgtgcgtgtgcccttgaaggaaaggagatatctcctaaggaaacaagaatctgttcatgtggcccttctataccgtgttggtatatatggtaaaattgatgttggtgtgggtcaaaagtagagtgaacaaattctaacctaaaagctaaaatggtgacaatacccctggtactgtatgggtatggaaagtaaggatgcattgtgcgactagacacttcctccgatagcaatggtgacagcagtaacagcgccagcggaaatagccggtctaccagattttttacctccggcagcggcaataaaacgctcattgctcaagggaccaccaggaaagctgctttcaccagtaggaccaccaggaaagctgccatcaccagtaggaccaccaggatagttattattgccattaggaccaccaggaaggtcgtaatcctcgacaacggcctgatcgaggtcgccaaggggggccatgggagcgagaggagaaatgtccccactgtcgtgccatttgctgggtaaatcgccagcgtgagaggtggacgagtcattggagcgatgaaaacgcgaaagacaagtacccattgctgcaaagctcactattgaaatgtggagcggagcaagagatggcggagaggcggagaaggagatgtgaggctgatgaggcgatggacagcgggaatggaggttggggacagagaatggtgatggagagtgtggatgaaaaagtagaagtaaaaacgacacgaatgtgggggagagacacttttgcaagacacgcacgcactgttttcgcgtgtcgccagcaggaacacggtggggggatacatcgtttagccaaggctcccgctatgaccatggacaaaagcacaggctttgtccagttgtccatctcggtccctgactcgtgcactgcaagccgccaacaggaacaatagtcacgtctagcgttgcttgtgggcacagcaagggcgcagtttccggataccacataggagccgacgatacttgcaatagaaacacaatgggatggaatactcctttcatgctactcgtgctctttgctttttcaaacaaccagccagactcttaaatccttaagttcttaggtttataaaaaaaatgcttgttttgcaagatctgatcgttcatttcctagcaaacaaaccgaatttaatcggtcttgggagcctccttgtaggagatgacggcctcctcgcccatggcggcaacaacggtgacaaggagatccttgccatcctcgaagtcagcctccatcttctggccgagctcaccctcggggaccttgacatcgtccttctggtcggagttagcgtcgagcaagttaaggaaaccatcgtcaatgttgacaagagtgtactcaacacgcttgatgttggggacctggggtgagaagaaaaagagagatatcaattctctgcgcttcgccagctactgcatctgattcgggcacacgtgaccaaatgaatcattttttcttgcgttgcgtgtacttacatccatgttgtgggtcgagggggagagatcctcgagcttcttgccagtgaagatatcaatggcaaccaagtgaaccttggcgtgtccgtgcttgccggtcttggaggtcgacatgtcgacgatcttgcagggacggcccttgatgacaacgtgtccgttcttgcgaagagcagagcactgcatggggaaggtcaaggaagcacccgaggaggtaccctcgaacgtgacgttgtgctgctcgtcgtcgtgttgatcggccattttgagtctacaacagtgaaatcaaaggaacaatactggtaagtttccttgataactacttctaaaagtgacaaaaccacatcaatcgttggcaagaatagcaatcccgcacaagtatgcaggagggtgaggaggtgaagcagtttgcgtgatagtgcattacacgattggagaacggcctgctttgctgcagcagtggttacaaaggagaagtgaaaatgttggagggtggaggccaatgatagatagtttaggggagaaacacgacggtggacgtcatgatggtaaaataaagcgcgaaaacgataataaaaacgtagtggtgtaccagcgttgagctcgtggtggttagcttcccacagcatatcacatttcctgggccccttcccaaatccttcaagcaaaaatgttgtgacaccacagtagaccttttcttagatcggaagatgaataggaggggcggagggaaagaaaaatgatgaggcgatgaatggtgacagaggagcgcaacggatgcctttcagtcgacacgcaactccttggctgaagcctgagccttccaagcagatgccgaagctggcgaagagacaagtgtcgtcaagaaccagagagcaagacgaatccgattcgtttttctttcatcttgagtgccgatattcaagcttgcgagaaagagagtgaactgtccccccgagatgagatgcgctcctccagatgctaatcccgaaaacaaagacaaacagaatggagagagagcgagcgagagccgggggcgcaagcgcgggagagaaaaagggggggtggggagatatgggcgcatggtattaccttgtaaagtggtgaggagaaaaggaaagaagagttgttcgcttgtgaggtgagggcgattttatgagtgagtccgacagagtgaaaaaaaaaacaaacaaaaaaaactcttttgaattttaaggggccttgccagcgggaatgccgaggacacgtacaccggcatctgtacgtgccctgcctcccttcgacctttgcttcgacatgaccctctgcgcgagagccacgacgctcttctcgttcgcacctctcactccctctctcgcccatttcaggacacatcccacacacgccggcgtcctcgtctttgcctctgtccgctcgaacccctgcttcctcgaggagtagctccggcacacccatcatcccccctctcctcctgaggcaccttgacgttagactgccatcatgtacaacgtggacgcatacctaaagtccctgacgtccaatgccgtgaagctgtcaaagaaggtccaggatggcatcgccgagaacacacgcgatttccgattcgagaaccaggcccatttcttggagacgaacgatgacaagatgaggtaacataactccagcgctggtccacgacctggccacgtagtcgcaccgcacgctgctgcccttcagagcaatatatttcgcgattttatgcctcgtctgattccattcagagagcaggagccatggagtacctacctcaagcagactactaacgctagttcactcaataacggccctctagggaaatccgcaaaaacctggactcgcgatacgagaaggaaaaactggatggactgaagagactgatcgctgtatgtgtcgtcgggcagcgttatctaagtagcggaagatctcaagctacatggcggcatcgtatattaatcgcacctacgatgacaaaaatgacactctagatgatttccaagggcagagacgtttcagagttctttccagacgtggtcaagaatgtggcctccaacagtctggaggtgcgcaagttggtgtacatttacattctcagatacgcggagcaggagcaagatctggcattgctctcagtcaatactttccagaaggatctgagcgacaaaaaccagctcatccgtgccatggcccttcgcgtgatgtctggaattcgagttcccgtgatcagtcctattgtcatgctgggaatcaagaagtgtgtcacggatctgtcgccttacgtccgcaagattgcggcgcacgccatcccaaagtgctaccagtatgttttctatgtagccaccgagcgcgccgactcaagggagaaaaatatgcgcgggatttcaaagcttgaaactttatactgacgtatcactctccgcatagactggatccggcgcagaaggacgccctgttggacattatcacaactatgctcggcgacaactccacattcaccataggcagtgtcctgatggctttcaaccaggtctgtcctgacagattggacttgatccaccctcagtacaggaaactctgcaggatgctcgtggatatggatgagtggggtcagatcacagcccttgacctcttgctgcgatactccaggtacatttccaactatggatagactcccaccatggtgctaaatgaaaggcattagctgaacctgcgtcattataactctgcctgatagaacccagttcctgaatccgattggaaaatcaactgcaacaacggcagcccgcagcaaaaaggaaaagagcgtcgccaaatcattctactcggatgatgactcggatgtctctcatcactcggacgaaagttctgattcctcctcggatgaagataacaacgccgtcgaccccgacctcagcttcctgctcaaatgcgccttgcctttattgcaaagtcgaaatagtcaggttgttctttctgtggcgaagctctacatgcatctggccccggcagaggattcatacaagattggacgtcccctggttcgactgctcaggacgcatcgcgagattcaatacgtggtcttgaacaatatcgttgccatcgccagccaaagaccctacgtgtttgaccagttctaccagcactttttcgttcgatcgacggaccctgttttcatccgcaacctgaagctcgatatcctcacattgattgcgactgagagcaacatcacatttattttgcgcgagttgcaggagtacgtcaagagttcaaacaaggatctggtcacgcaggcgatacaggccatcggacgttgcgcgtctaatataccagagatggcggagagctgccttggcggccttttgaatctctcctacagcaaatcaagtacgtacatcattccggatgtggtatagattctcacagttagatgcacgcaagactgcccatatttactcgctcgttgcgctcctcctttttagattctgtcgttgccgagtcagtggtagccatccgccgtttgctacagcagaggccaggcgacagcgtggtgatgattactcagttgacaaaggcgttggatgaaatcacggagcctttagcaagggccaacattttttggttggtgggacagttttgcggccaactgccgacagtcgccccagatgtgctccgcaaggctgccaaatcattctgctctgaggtatgatgacgcccgtttttgacagtgccgatctctatgtattgtcactttgatgtactttgacacttctgccactgctaaaccccatcctctttggctggtctatcgaaatatagagtgaaagcagcaaattgcaggtgttgactctgggagggaaactcgtggcacaggagggcactctttcaaggaccatcaacctcctgtttcaatatgttctcaacatggcgcgctatgacctcgactacaatgtgcgcgatcgggcacggttcctgagagcacttgtatatgggtctcagaacggagcagcagccgccacagaacaggacattgatgaccaggagagcggatccgaagagcaacatgcagttgaagggggatcgacaaaggacatgagtggattcgaatacagtgaaaaggagctgaatctctcggagcatatcaaggccattctgctgagcgaaaaggaggcgcctattcaggagaacccctcgcatggtgagttttaatcgtcttctaccctctcttctattgtcactgtggcctgggaacttacgtttgtccgtgatcgattgttaggacgtgagcaatataaggtcggatccatgtctttggtattgaaccgggtggtggcaggatatgaacctttaccagactggcctacgacacagccagatccctctgttcgccgattggcggccacgatggaggcgccgggctacatgaacgaccgtactggatttggaagcgactctgtatatgcacagagccgtcaaggccagggcaacagcaacatgagctcctcgggtggaatgggtagttcacggtatgatggtcagactggagcataccgcggagcggagaccctggacaagtttttggaatcatcagaggaggaatcaacggattctgacgaggactcttcatcagagtcagagtcagagtcagaggagtcaagcgcggcggagggttcgagtgatggcgacgaggatgaagaaggaagcgatgaagatgaggaagagggagatgatgatgacgaagaggaggcgtcttcttcggaggaagaggcgatacttcccaccactgtcaagcgcagtaacgggagaaagtagtagcgtccgattaaaaacattcctcacagctgtcgagggatcaactgtgcccatgcgctctgtaaaagttgctcgcgcacggatggaggcacaaagctgtgctccaggaccctgtgatcatgtcttgccactatttgtcgcgtcgttcgaacaggtctatgtgttttacaagcaatggtcgctatggacgatacttatgagcacctgcgagagagcagagtggaaaggacaaacatacaccggtgcttcgttgtgtcctcgggaagtgtatatacatggcatgcagctaggcagccttgcacattccgagcgtgcacctcctgcgctagtccttcggagcaccgtggtatgactggagactgaacggcaaaatgatcagacgagggtagcctggtgtttgaaaatcattaaatgacccaagcataatttttttgtttgctctccacacatcgtctcctccctcttttcttgcttccgctgaagattccatcggccagtcccctgatccgtcagtctctgccataaccctcatgtcccacataccctcggcggcagaggcgccagcttcaaggccgtcgcctacaacgccagttcccgccctagagtcaataccatccccgagcgacgccgataccagcagtaatagcccattcacgcacaacacaatcaacaacagcaggaatccatccgctcattcattacctggaacatcctccgtttcgcatctctttaccatcacgccgcacgattaccagcttgtacaggactgggcatggagtaagttgcgagcatcactgcatgttggtcccatgccatcggcccccacgcaaaacttaacaaacacagaagccaagcgactatgggtgttgacccttcgagattcccttgactccaatcaacgtagagaacaggacagtgttggcagcgtccagtgcagcggtctgcagcgtgctgtctggctttccggtaagaaacttttttgatgatgatgattttgctgctgtttcagtagatgcatccccccgcccgccctcccccagctttgcttttatcaggaatcgcaaacggcaacttgagaataaccggaggacatggacatggtgaaatagcgatcgtagtatctatccgatccgcgttcctcgctggggcaaaacagtcttttaactctcctcactgataagcgatctgatctgtctggaaatctaaatattttttttacttctattttagtttgactctgtgaagacaaggatgcagacccactcgtacaactccatcatggactgcgtcaggaggacatatgcagaggaacgtttgggaggattctttagaggtaaacgaaataagcttgcccttgatcgctcatctcggacgcatcgcggactgatgaacgtgggctagagttttaaaaggaaaagggggagaaaactctaaccgtcctcattgctctgcatgcggtatgatgacatctaggcatgatcccaccattgatcacagtatcgattattaagtccatttcgttttcggtctatgaggggtccaagcagcagatcaggagcaaatccaagtcattgcagggcgatacgatcccgtctctgatcggcctcacatttatctctggaagtgtagcagggacggtggttgccatgatgtcaagtcccttggagctggtcaaactgcagcgacagctggaaaagctcatggccatgcacgcccgaaaggaggctgaaatcacctccttaacaggagatgcccttcttcgcgaaggcttggcaacggaaaagaaatcggccgcggcagtggcggccaaaattgagcgacactctcatggatccatcacgcaatacggaacacccaaggaagaggcgggagcgtccagctggaagactgcaaaggcgatcgtgcaaaagaagggctggacaggactttacaagggcgccaacttgcatgtgtcccgagacatgctcggcacaggcatctatttttccagttatgagaccatcaagcgactcatgtccgagacaatcgagcgcgtcaaaccgcacccccacaacgcgtcagagtccatgactacgacacagctcaagggaccaggacccatggtccatttctttgcaggaggtctctgcggtgtgttttcatggctcgtggtctttcctatcgatttggtcaagagtgtcgttcaaaaggaggttctattgtcgaaaccaaagtactcgggcgcactggactgcgccaaagatatcgtccgacgggaaggcgtgcgggggttgtatcgtgggttgagcgtaacgtgctacagagccatgccgatccactcgctcaactttctggtctatgaggcggtcatggattatgtcaagacttggtcgggtcacggagagccactgcagcatgatgcctctttggcagtcatgacaacgcccgagtcctcaatatccagatgataagcaggatgaaaaacaagtaccgctatataaggtgaacaggaggacaaaaaaaagcttttgaatctcttgtgaattacaaacccccacaccccactctcttccgttccagacacgtcttatttagaaccaaaagaacaataaagattttgtacattattagaatccataaactggacgacgatgcgatacgccagcaccgccatcctcgctggtttggtgggtatttattgacgagcccggggatctgccattgtctatagtgtctggggcgatggaggcgtacgaggaagccgcagacgcaatgcgttgatagtggaataagtgccctcgcattcggaccacgtagccggaatagaccaacgctccgatgacgacgcacatgagggatagcgtgcaaggtatgaagtacaagtctggaagggaccagatcatggtcagaacgaactgcgcgagctcaaaaagattgatcatggagtaatgccacccattgatgagccctgcgttgtcgtggtcagactgtatgtgctcttgcatgatctgggtgatgaccaggtcaaaggaccaaacacctatccttgatacagccattcccgctatgtagtagttgaaacgacagaagaaaaacaaaaaaaacccctccgatctcgtcagaaacctttgatcttgactgatgttgacctagtcccattactcatggagggcgctgttaccaaagataaagatttgcacgggcaggcgatccgaatagatcgagaaaaggacgggcgtcagagtcgcgacctcgagccagacagaccaggctcctccacggaccaagccaacgtaacgcacgaggattggcatggcgatggtccctacgagctcggatgccgtgcagacgcccttgagaagtgcaatggatcctgctgtgaagcctcgccactgcaaatagcctatcatcgtccctgacacgctggaaaaaaaaagcaacactgatcagtggtggtttcagaaacaaaaaaaaaatacgcgttcgttttttttttttgtacctcatcatattgatgtatatgatcgcatatgacagtgaggcgaggaaaacgatatggtgcgtgtactcttgaaacgaagagaccacttttgtaaagacagaaggcgatctggtggcaaagagatcactggcagaccccctccgccttccgtcactcttgctcgcgttcgtaacgctcagttgagaatgacgcgatcttggctcccaaaggacgggggacttggcccaaatgcgcctgacaagatacagctccatgcagaacgtgcacatgcaccaggtcgccatggctaaactgcagtacgcagcatcgacctgggccaagagagctgcgaacaccagaggcgaaatcagtttgcaaaccaagtcgatcctcttcatggccacattgatccctatctcgacacatcaagcacgcccttgtagttagaatacgcgcctgcttatttgatatatctgccgcgtttgagagatacagaaacgagaggacagagacgtacgggtcaactgttcagagtcagatcgacatagagccacgatccagtctcgctcaattgagatggaccaacccagggcggagagtttcagaactccgttgatgaggatcaagagtgtaaagacgctgtagccctcatagagtgatagatcaccggtatgggaggtccctgaggtggggtcgaaccaagtcaacaggacccagaatcctagggctcctagtatggtggacactttttgaatgaaaaggaaggactggacagctggggtgaaattttcgtagtgagcaagaaaacatgtggatagattgataaggaactcatcaagaatgcccaactgggaccccgcgcaagttgtaccgtacgtgctagccgaggtctactgtccacaagtgatcctatgatcgtgctgaaaaggatcccagcaacggtggtggagaaaccaaaaatggacatgggcagcagcgtcgtcttgaagatctccatgatgaaaaagtaggatgcaaactcgtagatccgctcgtcgaacgtgctgtgagattgtgaaaatcagtgttgtttatgcgcatgcgcgcagtgtgtgtgagagcgcgcaacccgatcagatcgtggacgtttcacatatcaaccacctacctaccagagtgcgtggacagcatagagagtcatggacggcacctcaaagcccatcgcatgatcacccctatcctcgccatctatacgatgctcgccgccttcaccgtgaccttggctgtggtcatcggattgcggtgtggtcgagtatatcctcggcgtggtagtagagtggagcagaggttgggctggctggcaaacacccttgatgcagtggctgttttctgtagacaacgtagaggagggtgagagcagcagtggggagggtgaatgaggactcatgtgtacttgggacgaagggcgaggtggaatggacggaagaatgcgagacttgcgccgagcgagaataacgtccaacataaggttcagagccctgcagaacgatagcggttgatccagagacaggtgctgacacggaagtctgaagtgctctctctgtctctccctctctctctctctcgtcgtctctctcgtcgtctctctctggcaccaaaggcggatgtgggcaacaggggcacgcacgcggtgccagggaatcaacagggacccagtgggagtgcttcccaaggagctgtgcacagagctgtgcacatcccagcagcgtgcccgacacgaacgagacaaaagaaaagaaaaaaaaaacggtcctcgtcctggctgccactccattctttcgccatccccatcctcgcctcctgccacctccttccctatcgctctcttcctctcttcctcccaccccccatctactcggctccacccctctgctgcgcacacgtccgaaacgctctcgccctcattcagcagctgactagaagagggccttcaggatcaaataacacactctctcaggaacaagtgaccctttgagcgactccctcctcccacacaatggactcgtcgacagacaccacggccacgtccaccagacccagggcacgccatgaatattggtgtcatcaggcaagaatagaaacctattctcctccatacacgcgttctctttagcataacgaggaattcgaagaatgcgcgtgtccactcaacgagcttctcattgtcttggcacttgcttctcacgtatagtgtgcagcagaaatcaccccaatgatggtgccggatcccatgtgcccaacctgccaaagcgaattcgtggaaaaggtaccgaggataactgatcgctgttaaaaaaaatgtggcaatcagggaaacagacgcaaatgagagcaagggtctgcttaataacagtctttgcctttgatgggatacgcgtagatcgaggaggaaaacgacccgcgtgcgtttgccgagagtgctcaggagcacgagcatgggggcgaggaaggagatgaggtcagagagactcttagtctggaagatctctttcatttgtttcacgcactttcaggcgccccaagagcccagcaggagcagggacaggggctaggacagggactaggacaagcacagaatcagcagccgccggcagagtttccaggtgcacttccgtttatctttaacccaggaatggtgccatctcggacagggacagagacagggacaggaacaagggcagggataacaaatacgcagagaaacttgggtggcatcacaggtctagtcgatgaggacgtcgaaatgactaatgctacggaagacgacgaacaccgtccgcctcgagatccatcagtgtctcttgcaacgtaaggcgtcaggaaaattatactctcacaagcagagaatggccacattacgttcgctcaaactcatcccttgcacattatctcgcgatacagtcttttagagagcatcggattcgatctccagtacggcagtgctcaaggtgcttcaccaaaccctctcggtggactcggcagacttttcaacatggtcgggaacccaggagactatgtgtttggccagggaggtcttgacgacgttattactcaaatgatggaacttcaaaggtactttgaccgcattgagcgcagcccaagcatcatctgtagcgcttcgctgacgatgtggccactaatcttttgtcatattcagtcgccaaagtggacctgtaggtgcatcggacgaggtcatcaacagcatacctctacacaagctcacggcggaggaactaggtaagccacgctgccacgtggatctgcaagctacattcacagtcaatccatatctctgcactactgaccagtgatttgtcttgtctgttacagatgcaaagtgggaatgcagcgtgtgcaaagacgagttcaccaaggaggacacctgtttgaagctggggtgcaaccacatttttcatgatgactgcatcaaaccgtggctcaaaacgaacgggagctgtcccacatgccgtttctcattggtgcctgaaaccacccctgcagaggaccgaccagaggacaattcaacgacatccacagcgcacagagaatcgtcctctgacaacagggcgtctaccccgcccagtgacgacctggactaggacagaacctgattaaagctacgacgcaacgcgaggggtaagcaggctgattgcgctaccatttaaagggtgagggcgaggaacttctcaccaccacgtatgtgcagtggcgcgcaaggaccaccgtgcgtcgcgctgggcctattgtcatcatctgcgcacagtagcaagatcaggcagcgggctctccttgacctatttcccctcgtccctctacagtacataactttttgcttgtcgtcccgcctgttccaccctcaccctttccgctggatttccagagtcgactctgtagtctctgtgtttcccatttccattgcgtgtcagctcggtacaacgggaacgctttgcactcctatttcttctcgtgtctatctttatgtagcttgtatctctactcttgctcccttgcttttatacgcaccattcgcatgcccttactcttcagcaaagaaaccagcacagcagcagatatgactggcatactcgacgtcaacttcgatgaggctctcgccgccgccatgacaagccactacactgaggacctggagccccacctcgctcagaggtcgtttttaccgcactcgcccaacattccacgtaacagccgcagcagcattagctcgccctcctccagtaacagctcattctctgcccggaatgactcacccgcttatagcaatgggtctccttcgagcactggctcctccctcagcaatggcttttctcggtatgccaatccagtggacaggagaaccatcttgaacacccgccagcagtttgaagaccaaagacgggcaaagctggacagcctcgaggaagccctttcgcgattggaccttagtaacgcccgcatcttcacaggcttttctgggttccaccgcacgccgccgctattcaacaagaacgacctggcgcgcgagcgcgacgagcttatgggcgagctgcgacactttacgttcttggagaacaaaaagttctataagcctatggacaaaatgatcgactatgtcgacgaggatggatttgtagtcgccttcagcaagctgcacccgccccctctcccctctacgatggatatctcccggtttgaatatgccaagccgtgcgcacccatccagatgaaccaccttcggctcttcaatcgtttacctcgggccatgcctcccaaatacagccgcgcttttcgacgcgccgtcgctcatgtctcggccttaatggaactcccccacaagcttcccatgccaacaaaggaagcgctcgccggcgttcgatttgatgggagcaaatttgcgggactagactatgcgcgtaacggatacaagaaacgcgccgatgctcatcccgtcgcgcttcctgacgcccaaactgcctgggacaaactcatggcaggacgaccagtgcggcctcacgacgctcggttgggtggaaagggcaagctgatcgagcgtgatccgacgcagtacgccagggtgcagacggacggcacggatatatcgatggggcggctcattctcatgttgagccacagggacctgttgattctgggcgcgctggagcagccgttgacaagttcgtacctggacgagcagtggccgatctacattggacaaagctggtatcatggtggtgccgagaagtttgtgaacaagatggcgggtcatgcgctttaccactgcttcgatgccaagaagtttgacgcggcgattgatggatggctggtgcgagaggctctgctgattctccggcaacagttcgagggcggtatggacccaaagtatgacacgctttggtcgttcgtgtacgagagtctggtcgaggtcgtgatttgtcgcgacgacggcatccgtttgcagaagcatgtgggcacgacgagtggaaattgctttaacacactggtccagagcatcatcaccatgtttctgggttacactgctctgatcttcagggccgaggagcggatgggacccataggaatcgagaaggtcttgaccgagtgcgagcttgaggtcctgggcgacgatatggtccttgcgctggagcacacgtggatctttatgacaaaggagattctcgctgaggttgtgcaggactgtttcaacatcgactggtccgggaaaaagactttctcaacccaaaagatcatggacgacactttgcctgacacgtcgcctttcaaaggcattcagtttttgggcatgtattttcgacaccagcgatggggcgatggtccatttgcccccaagatcgtcgtgccgtaccgccccttccgggagagttacctgtcactgctcttccccaagcatggcgaatactcgagagagcactcttggctgcgagctctgggtatctacctgaatgcggccggtaacaaggacacccagctctggctcgaaaaatacatggactttctggagctggtgccctttgtgcatccagacgcgtggcccccgagcatgatccgaatggtcacaaaggactactggggcctgggcttgaaaccgccctcgccagatcggatctcgattgacgaatggtaccgtatcgtctgcgctccgcgagaaagcgaagaatgagagtcgctggcgtgtgattttttgtcaggataccgaataaacggggctggcgaccaggcaccgggcacgtgattttttgataaaggcaccgggcacgtgagagtactccgacttaaggggcaccctccgtggctccaaggtcctggtcgccgaaagccccattcttttaacaaatcagctcatccctggtagtatagtggttagtatctccgcctgtcacgcggaagaccggggttcaattccccgccaaggagcttatcttttgccttttgccgctgggaccccgggatccgggatccggggcctctggggtcgcgaaagaaggtctttgaggctctctttttgaagtgatgagaaactgccctgttcttgcgggtgacacgaaattattatttttacaccggccactcgaacctgacaacacttctttccagcgcactctcactccactttctaccctcccgtgctcgcgaatcccttgagtctcgacctcttctcagtatgagcacacatgacgcttctcataagggcgtgcatctccttgtgctctcgcatggcctgtggggtaagagcaggaacctctgatgccggtagctgtgcattcaacaaaagcttccacccacccatgcaaagctgacttcttcttttcatgaaactgttcttcaatgaatgtaggaaatgtggcccatgttcgcttcattgcagagcagttcaagctgcggctcggagacagaatcctcgtggtatggcaggcaggcagcaaactgagttgtatactagctcgagtgttcccgcttcctaacacgtactttggacggaccgccttcccgtagtaccgagcacaggcaaacgagtctgcgctcacatacgatggaattgatatctgtggacagcgacttgttcaggagatcatcagcgccatacaggtgatcgagactggcggcaacatcgaggagatgaagggacaaaacaccaagaaaaggaagttttttagcaccaacaagaccagtagagcaacagcagccgcgcccaatacccccactagaagcagtgaggcggttttagatcctgcacttcaatcaaccgacaccagtgccggcactcctctgcatccagaagagctgtctgataacgtggctgcttcgacatcggacaccctcaagaaggtgacgcagttgtcgttcctcggctactctttagggggactcatcggccggtttgctataggcatgctcgatcttgaaggtttttttgagccagttgagcgcggcgggcgaggcatcgagccgatgtatttcgtcaccatggcgacgcctcacctcgggatccgacaaccttccctcacgcgatggtcaaaaatcttcaactatctgagcgcgcggatgttgagccgaacgggtatggtgtgatcgagcacatgtcacattgacgaacctctgccactcgacatgcttcgctgacacatcttttttttctcccttttctgctttctcgtaataaaggcgagcaactgcagcttgtagacaactacagaggaggaaagccccttctcctggtactatctgatccatcgagcgtatttctgcacgcgttggcacgtttcaaaagaagggttttgtattgtaacatccgaaacgaccgatccgtgccgttctggactgccagcttctctgatgcggatcctttccgggaactggggagtatgcaaatgtaagcgaacgccaatgagcaagcactactctcatcggcctctaggccacagacctaaaaaaaaaccttgatcatgaacaagacaaagaaagtaggaagaaaaactgacgccgagtcccctctaactcttgcgaaacgcggtgcatgatctcttagtcaatataacccaggatactcgtcattaatcgagtcctttgagcaccaagacctcgaggcactagcgcgacaggagcaggatcgcaaggacgcactaaaagctgcctcgatgagacaacggataacacaacggctcagggcgataccttggaagaagtacattctgttgggaacgctggggccgattctgattccattgtggctcttgtttgcgtgctcgacgatctcgatccaagggctgaactccagaaggcggaccaggcccatgatgcggtcgaacaagagtttggagcggatgcgggatgagcatgtgatcatccgaacggcaccagtaccgcagcaccgccgactgtcgcgcagcagcttgacattgggacaggcccagcgcgatgaagctgaggacctaaacgccgccgcttcctctaatgttactttgactgtgcctgttgagactaccacccgtcggaccaagagaaccatgtcggcttcctcggagacgtcgtctattgtcgagacgattagtgacgacgatgatgatgatgatgctggtaacggggagcaggatcaagctgagccagcagaagagctaacgtcgctgtcatacccgcatttgaagaaggtgcgaccgttggccttgcttcccgttcaggtcgagatttccaagaacttgaacaggctggaatggagaaagaatattgtccatattgaggcgttcaatgctcacgcgtcgattgtggtgagagaaaagagattctcgaatgatggaggcgtagcggcggttcagcatgcagtcgatatgttcaaggaagacggggaagacgagtaaggcgatggatagaagaaaacactcccgctggagaataaaaagggccagactgctgttgttgtatttttcgcttcaagatgtttattgtatgatgctggtatatattacatggagggagagagatagtgtgtcataaggagtaaggtctcagacgagcatttagaagccaaggctctccttgatgaaaagaacttgaatacggttagggttgaaagggttggccttgcggatgacctcgtaatggttcaaggtggtggcgggggccttgaagacctcacgggtgaaggcactggaggcgggtacgcagtagtcgtgcattctcttgagggcctcggcctcgtccttgacgatcttgttggatccgacgacaacaatgacgttcttggcaccaaaggccacgcctccgaccttggaacccgaaaagtcaccgtgagccatttctccagactcggtcacggaggccatggaggtcaagaagtagtcgacagtggtgccgatggtgcggcggagctcggcctgcttgccgaggtccttctcggccaagatggtggagcgcacgttgttgtagggggtctcgcccataaggtagttgataaatccaatctggagagagaaagagagagagagatagagtggaggtaaagaaaacgtgtgtgaagaatgagtatgcatgcagatacctggtctgtgtgtttgatgatttgtttggtgatatccaaaagtcgggtaatgtttggcccgaaggggggggggatcaaattgattttttttgtcgaacaacgtcgattgtcatacctcctcaagagtggtggagtgagccacgttcaagctgacgccctaaaaaatttagaagagtgcgaagaggcgaagagtgagcatatatagcagaggagggaactgtgtgccacaatggaggctgtagatgtgtcatatctcacttacagcagggatgagggtcttcagcttctcaaaggcctcgtccttgttttcagagacggtgaccttaaacccattggattcgagtccggccttggtgcgggcaaagctctcctcgctggcgtgcttggagtaggcgctgtccttgaggtggttgatctggccatcggactcgatcagagcctcgagagtagtgttggcaaaggtgttctcgggacgggacgacattgttgctgaagagtggttgtgtagtttgctgtgtgagaaggtcaagagtggttcaaagatgctgatgctgatgccaatgctgatgcaaaggaggaagataaaaaatgtggttgaagaaagacgagaacaaaggagtgacggagaagagtatttatgtgaaagaaaggccgccagttggaaggaaaggaaacaggtttttgtaagaagttcagggcacatttccaatactgctctcaaaaaagcggatcgacattctcccttgaacgcttttgactggttggcgggggtgttggacaggtcatcgagtccccgctgcaactttgttggccacaatcttattcagcaccacccttattcagcaaggtggcttgaagtgtggctccaccttccacattcatcactcaacgcggcatgctcgcctgtacaggtacaaaaaagtacataaaagcacgcctgacccactcgatcaactggcgatcgtatgctctctcgcccagtcctgtgaaaagccaacgggaggtcaggtcacctcccaacgcctagatacgcgcggtagggagccgatagcacatgtgaactctgaagatactccaccttggacaacttcagccacaggtatggcaccaagccatctccaagtgtatggcgcgaggcattcgaaggcaaggatgcggaaaggcgtaaaaagttgtataagcagggggttgagcggatcgcgtgtgtctctaaacatttgtgtatcctcaaaatcgggtgcgccaccattttgtaattgagcatgtctgttctgccatgcccgcttcgccatcgaccccatccacctgtcagagtccgcacgttcattaagccagtaggagcaactaccaccactgctgcatggtcgtcaaagcgacacaatggaaactctgttcgcgctattccctcagcattccgcggccgatctacgggaccatctggctcgggccaatggggcactggagcaggccatagacacactgctggccggctcacaagagagcacaacgactagcgataacaacaacagcggcagtagctgtagcagcagcggcagcagcaacaatacagcccaccagagcgccagtatacgggacaagaacccggccaccattgacctcactcgtttgggacaaggaagtagctctggacataggcccgccgtgatcttggatctcaccaccgactcttccgacgatggcgatgatccagaggacatgtcgttcgaactctcttccacctcagctggccccagtatatatccaccacataatgcagtaaccgtacgcgaagcggtcctgcaggagaacagtggggcaaacgcaggcgtagatggaggcgtgaagattgcggcggcccttcctagttttgatgactttcactccgagcagcagaggctcatcgaggaacagcgcagactggaactggaggagcgattgaggcgggcggccgaagcagccgagctagagcagcggataaggctgctctgcagcaatttcatcacccttgctcaggacatgttccaggatatctcggtcgatttccttgaagatctcatgcgaaggactatacccatactgtcgtccattgaggagcttgcggatgcatgcatacaagtcatcaccaatatgaagggtgcctacccgcgaagagcgaaacggaagcgttctatcgatgacgttggtaacgggcaccgtgggcaagggatccaggagagcgatgaggatgcatcaaattctgaggaggaggcggatgtcggtagctcgtcttcgaacactcaagctcacctttcatcccagacccagacccagactcagagccagcatcccagccgaccgcatcgtaactacatggactgctcagttaaattgatgggagcgtatgagacttgctggtaaggaaataacgatcatgctgttcatagttgcggtcagatgtcatatttccattgtgctgatgaatcatgcttgctttttttcagtctcaatcaactttacctggactttccaaagatttcttccgggaccatcaagaactgcatgcggaagcataggaaccactacgtcccaacctttgaatacattacaaatctttgggctgaactcgagacagctcctggtagaagaacagaggcgtccgccgaggtttttatgcaggagcttcagacaccccggaaggagaaaccgaagcgcggaaagcaaatagtggaccccgagtttcaggcagagttggactggctgaaggctcgaactggtaagagcaccgccatttttgttgcgctacacgtagcaatatgtatagcgagacgtcgaatacctaacgttggtgtaatgttttttagccaaggaagtggccgaaatcgaggcgattgagaaagaagaaatgaacacggcctattacaaggagcgcaacgagctgattgagtggtaaggagatggctgattgaaccgcccatggtgcagaacccggcactgtagaattttaatcaaagaaactcattttgcttgttggtcttagcggttgctgctttgatgaggtggcaccgaatcgagtcgcccagtgcgaagatggtcacctcttttgtatggaatgctctagacgcggcgctgaagttgagatcggctatcagaggactgtcttgaagtgcatgtccgccgactgcaagtcagcgttcgccgactctgaagccatcaaattcctgccctcagcagtcttcaaaggcctcttgagagcgcggcaacagcaagacttgaaaatggtgagtattgacaaactctttgatgtgagcagcgctatttatgtgaagtacagcgctgtttctcactattttttttattattttttttgtttgactctcctcttcaggccgggttagattcccttgtcgagtgcccattctgtccctatgccgttgtcatggagaatgagaatgacaaggagtttcgatgtcaggctcgaaggtgccgcaaaatctcttgccgtctgtgcaaacaactgactcatattccgctgtcctgtgaaggtatgtcctttttgcgagccatacgctgcatttaggctcgctgctgcatttccctttgcactaatgttcattcctttgtgttacagagcatcgcaaggagcaagagaagaacagcgtgctttcggcgcagcacagggtcgaggagcagatgtctcaggcgcttattcgagagtgtccaaagtgcaaatcacggtttttcaagacagaaggtttgttgctgggcgagtcgggaacattatgatgagagtaacatacgtctgtcactggtccccctaacgcgtaattgtatcgtgcaataggatgtaacaaaatgacatgtccagaatgccataccaagatgtgctatgtttgcaagaaacaaatcaaggattacagccactttgatcaaaccccggcaaattcggcgcccaggaataagaaccgtaagactataggttcactgtgatacatgtcctttacacaagtcctgtcaacaccatctttgacctataatccacatccttcatcatagtgtgtcgactgtgggagaacaccattcaaaggaacgaggccgaagtcaaggcagcggcccaaaggtccatgcaggagctggaggcacaggaacctagcctagtagcccaggtccgcgttgacattcccaagtgacggggagaaataaagactgacaaacagagacatactgttcttgtgcattgatcgcgccacattctgcctttcttccgtttggctgagggtgcgagtgcaacctttctttagctttcttatgctacatgccatgcttagtagcgtcgtcagtaccccgtagcagcgtactcaggcagacgcctgaagactctgtcttaatggccccatttcgacgaggcgacccaagctttacgatttcctctgcagctgtgaacacagagatggcgtatatacgattctgtcattgtctggtctatggtcccgaaagctaatataatgtcaacgacataccctgccgacgctcgctccaatgtcactacaaggaggtaccagtggcgacttcattgttatgtcgctctaaataccacttgagcataccaaagacgcccttcatcatttcaggggaggtatatgcattggggttttctcaagaatcactaattaagctcacgcaccacggggtgacgagcctacatgctgggcttagtgttgccaacaaacagggttttttgtaacgtatttcggtctttgtcggatcgactcatttttttttttttgttcattgcgtctatccttcacatccttattccttttaccctgctacatagtctgtctcgctgcaaaagctcaatagcaaccctcgttcttttttatggtgtcttttattttagttttttttttttttttttttttttttttttttggtcttttgtctagcattgattttctgtgaacacttaacctggatggttccaccacatcaccctccacgtcaactccgacagcatgcacggcgtgtcgaagacgaaaactacggtgttcgggcccacccagttgtgaacgttgtacgaccaatcacctccagtgcgtgttcgatggagatttattcttcaggacgtacggtccaaacacgtttttgaccaacactcatggaggtggagtgatgacattccctacggccatgttacgcctgcccttgaagcaacagcggcagcaacagcatcagcagcatcagtctcaccacgcaatgcacacttccgtacggccagaaaaggactcgccagcgcaacgccaacaacaacaacaacaacaacaacaacaccaacagcaaccacagcagcaagaccaacggcagcttccatgtcggtcgcagtctcaaccaaccgcgacttttcaccgttgtcagcgacgtgacagtgaccttgataccaaatcgagctcccgtaaggggattcgtgcagaagaggggtttgagtcgcaagacgaacattggtcttgcggtgaggacgatgacgatgacgatgacgatgacgataacgataacgagaaggaggaggaggaggagaaggaggaggacgacgacgacagggaggccaccttgtccactcatcatcgccacaatcaacatcatcctcctgaagcgactactcctaaaccttttgatatgcccaagccgaaaaagtggaccatgcgaattgaaaacttgctaatctagcgaacggcgcgagaccccttgccttgccctgtcttgccctgccttgcctttttttttgttgttgttattgttcaatgcgaaacgataaaaacacttttttttattattttgtctcgtcaatggatcgcgtcgcgctcctcgctgaaaggcattattgaaccttaaaccgcgaaaaggaagagttaacaaaaagctgccttcgccgaataagatctcatgttgccactcgttctatcgcacgcggtcatcatagccatcctagattttgtttgtgcgtgtgtgtgtgtgtttgtgcgcgattagtcctcgtccactgtagatgatgttaccgtcgattttaagctcagtgacgcgtcattagcggttgaacaatcgagaacgaggagcgagtttgaatccatttcaaagtaaaaaaatctacaacttgtttgtattttatttttcatatgaacgacaatggctatgtgattagggcgtagtgcacgtatgttgaacacggcattgccaggggtatgttgaatactttacagagtgggagaagaatacagacacaaaaaaacattagaatcctgggtgcttcgacaaaagtaggaatagcgacgattactggacctcctcaaacacctcctgcttctcgccgccacgggtaggcacgacgccgtccagctccaaaagggcaatctccgagacgggacccttgaaccagtgacgagcagagaggaaccaggtcgaggtggtgaacacgagcaagaatccaacggctgcgggcgtaaagttgaacgtgtcaacctctgaaacgggccaggactggggcaagttgaagatgacaaagatgaaggcggtccagatgcaggcaacccatccaatgggcttggagtatcggccgaggttgaattcgcgctggacaaaggtctcggctccaacagtgatgcggagcaagattggaatcgcgtacgagacagtgaatccaatgatggaaattccagaaatggcgctgagtgtcgctgttgatccgatggcgggcaaggcgaggaggataatgaccacgaccgagagccagacgaggcggagaggcatctgtgtgcgcttgttcaggacagtccagtagggcgagaagggaagaccaccatcgcgggcaaaggcgtagagcatgcgcgagttggctgcgactgtagcaataccgcacaaaaatccagcaaacacaatgaggaagatgaggacactgcctccttcctttccagcgcagtccaggaaaatctgaggagctgctccaaatgtgctggccaaagttgcatcgtaatcctggattccaaaggtcagagccaaagcgagaccaagaccgataaggaccgaagcaaggatagacatgaggatgccgcgggggccattcacatatgacttttcagtctcctcggacatatgggcagatctaagagggcaataaaaagcacggtcgagacacaacgtgagcaaagcaccctttggtgtttgacctgcactagaacgaagcaagggacttgaacttacgcgtcatagcccagcatggaccactgggactgaagcaaaccgagcatgaagacaaagacggggctgactccaccctcggtcgtgtagccagtgtgatcctggaaatcggtgaacacaaacttggcagactggagcttgggggcgcccacgaggacggtaatgatgatggcaatggtaccaaaaatgtggaccacgaccgacactagcgaggcaattttcagggcacgacctccagcagtgttgatgataccggcaagcagcatcaaggcggccatgatggcaaagtccatcttgccgttagtctcgtaggttggctcccagatcttgatgagcttgttcatgaaggtagcagcagcaaggacagatccagagcaaccagcaactacaagacgtatagtatcatcacggacgtcagttgagagtggcttgtgatcgagggacagggaggaaaaaagccaaaaaagccaaaaaaaaaaacaacttacactgtcctaacatgttgaaccaggcctcataccacgagaacatgggtccccacttggcaccgccactatttcatagagagcaatttggagtatctgtcagtcaagccaggtacagggctcattttccctcccgagcacactcttaaatgccgagaaatcacttacagctttgcggtccagaagtacaatcctccggcagtggggaacgtactgcagatctcagccatgcccaaaccgatgaacatgacaaagaaggcgacgagcaaccatccccagatggcgacgacagggccaccagtgagcattccgaagccaaacaagggcacaataccgatcaggactgaagagttggtcagagtaaaaccaaagttctgaagacctgagaactggcgcctaagagaaaaaaaaaccccccacaggggagcgcggttagtacttgcggcagcagtagcagcaggagaagaggagcctctcatgcataccagaccaagaagggcgatcggcgtagtaacctacttcatgttttgcttgtaacccaactacgtggccgaagagaaagccgagaaagcaaggaacgaacgggaagtcagacgtgagcagaatggacacatgacatcgagacaacgggtcaatgacaaaagctggatctgcagagagaatggcatctctgttggccttacggtggcgagacgagcctcgtcctcgttgtagtcggctgcatggcccttttcgttgttgtccatggcgagagtggcgatggcaggggatgacaggggacagggggagcagacacagagaaggaaggtgctgcaaggaggggagtacgagcagggccggaaggatgaggaggaggaaaaagagacgagaacggtgagcagacaggaaaaggaacaggaaaagagaggactggacgaggcacgggaaagggggccctgcttttataggcaacacaacctcacttgagacacatgtgtttgtgtggggcaccagaactaatcagacaagaaaatttctgaacccaacccgcttcccagcacatgcaattgggcacgccaaactcaaatgcgataacaccaaatcaaaagaaacaacaacaaataccacaacagtcagcagaaaaacgtgctagccgtgggcacagagacaacacgcgcctggcgtggccgtgtttcctatttgttttgcgtccctctgtggcacagaggtacaaaacgttgcacactcgtgtgagctccaaggccgtcccgactgagaggagaggggagggaggggggggaggccaggatcttgcagaaggggggccagatctaatggatggcgcgtgcgacaaatcatttttccttgagatcgggatctgaaataagagttcgttggggcacgttttctcgtaatgcacgaggatacctggttgcaagtacagggcaaagccccttgctccctgcactcgcccgcaaccttgtgtagaagaatagactactaagcgtgcttccgtgtcgaaacaatggccagttatttcgactacagtacagaatacggcgcgcatttcaatttggcgggaggggcgaggcacgaagcacagcgcggaagggattaaattatagtattatgctaaagaccatatcactactctgcgctacgctaaactacaggggacaccactgaagccgttgatgttgatgctttggcagcagaggtagagtatgaggacggcccgccatggctcgtgctggtaaaggtgtgctccctgagcagttgaatcagctcctgttcttcagtctcatccttgcgatccggacgtttactacggcaaaagggggcgccatcaaagattaggagtaagttcgggttagataaagaatctctcaatggtcggtgaatttggacgactaccacaaattaattacccgtccttgacactaggcatatcagcaggacgagagacgtaaagtccgtcatctgcaaacggatccgccacaggagcttcctcatgagaggtcttgcctgctccaccttgattctcagaataaagaaccttgtatccagatcctaccccggcaccgtctgctgctgcagcatcgtcgcgtgggtattcttgccgagtagagtgtgagggctgttgcgccttcatggcccgcgaaagggctcgctgctccatcatgcggttgtaggcaccgagagccaaaacaagttcctcattgcaagacaatagcgccgctgcaggtaagataaaaacacagcatgggtaaggatgagaatatctgccgccaagtagactaaagtgaaaaggtcttgcgtgcttccctaccaaggcatttctcatcgggcatcgcttcgttggtcacctctgacaagtacatctggacctcgcgttgcagagttacgcatttggattgaaattcctagaacaatgccaaaatgcaaaaagcagcgctgcgttggtgaacagccctaagcggtggtgatacgcctatcttgcatagccacttacgctaaccaaggcattctcctcaactgcctcggtctctgggtcggcgaatgacaccgcctcgacgagcatatgcgcgttattgtttgccaactcgatgtcctgtcgaatctggatatttttctgcaagtagaaaaaaacacaaggtcaatgacattatcaagcgcatctgttaagaactctcttgtgcaaatggagccatacctgttctgcagtgggtgccacaggacgcataaaaggtggtgaaccgcgccgcggaggtggcgacattgctccggcggtaggaatcttgacaattgacggagactgatgttaactaatatgcacggtatgcacgatataattcggcgtgccgtttggctaacgtagagcttatgcttacacctcgcatgacatcgtccatcgaaagcttgtggtagagttgagggatgatctccaggctcggatccgacgagaaagtggttgtccaaaccgagaggcgctccatcagacgacccttcacgcgcgggtccgtatactaacatgccagttggggaatgagtacaacaactggatcgctaccatgccctacccttgcacataggcctttatctacctttgattccatgatttgctgaataaccagtccaaacttgatcgtggcgagctcggctaataagaaggggggggaggggggagatcatcatcattcttagaatgactttcaagggctttcattttccgctgcctcagctgtcctagctttgctcacctttgaacttggagccgcatccgtcgatcagcgcttgcatcacctatatttcatgcagatgaaccgccacttagtgccttcaacgacgcaggcgtttgcctcctctcgtcctgaagcgtaactcagaccttacagtaatcgagttcatttgctgctgagagtcaccggcacgaagtttcttccgcaaagctctggcagcctcctttgctctatatgtgtatgtgcatattatcgaagcggaggcgcaagaagagaggagatagaggtgtgagcctcgttggtattgagacagcgacgcgttggcgacagagagagagggagaaagagagagagtcgtgttcgaattttttttttcttacccgccatcgacagaattgactgcttgacaaagaccattgatcgagtaccagttggtgatgatcggggcatccgtgatgatgtctttgaagagtgggaagggtgtttgtgggttagacacagtgtttacgcgcttgaatggccactgctgtttgagtcggtgcattgcctgtaccgatttgaggggtgatgattgtgtcgtatgtgaagatgcccatgacgcggatgagggtgagagcgaggctcgttgaacgggggacgggtgcaaggggagggatagggcgcttgcgctcaagagtgtcgagcgacgacaagaacaaaggagagtgagagtgcgagaagggaagcaaccagagcaacttctttaagaatgcactggagcgcacccaggggtgtttgccaccactccaccagtgagcgagcaagatgtgacaccaggtggtggcgaggtgtcaactgaaccagggcaggaacgagggcgcgggcacgaccttcaccgctgtgttgtgccccagcatcgtcagcatccagcgttgccacatgcactccgcttgctcagctcacgttggctctcgcactcgttctccgaagtttatcggtaggataccgtaggcagttcactggtcttgctcagtgattccgctctacggaactcaactctaattgtttgatgtgtgcgtctggtgagaagcgtgagaccgaagatgtgacagagaaggtcggcagaagagagagcgtgggcgcgtatgtggacgggagagtgaacgagaacgcgggagtaggcgagagaggatggagagagagaggagatacacccagcgacgaggctgactgcaagagaccgagctggatccaagcaggcaaacggggttggtcgacgccatgtagacaatggaacacccagaggcgagaacacccgatggtcagagcagagcagagtcgaggtgggaacgggaagggacagacgagcagcctgctttgtcaggcgaaggctgtgcccatctgcatctgtctcgctttggcgagggcacgctccttttttgtgtgggtgtgtcgtcgtcgtcagagacgcaagaacgagaacgagaagggaagaagaaaaaaaaggatgcaaggaggtccgctcctgtcccgcccaacagtctgtgtgccatgcgttgagcctgagcctggagagagacagcgacagagagcgagagagaacgaatagacggaactgcacactacaccatgccatgccatatgccatgcttgtatatagcgcgcccccttggacagggacctgaagtcgccaaggtcggagcggaagaaaaagaagcaagagaaggaaacaaaaaaaaaaagaggtcgtgctctcgcgggtacccgtccttattgacctgatggaccttgcatcgctcttgccccttcttcgtgttcattcgcaatcaagattggatcctcacccttttttttcccctctctactcgtttcgtctttctgagcgtcgcgcgatgggcgagaaacgagagcgtgcatcgcgcgaggaagagagagaggaagagagagagagagagagagacagagcgtgcggcgagtgtggggacaagcgagaccagcaacaagatagcagcatggccatgcccatccatgtacacccgtcgagagtgttgtgttggtgtactgtcctcggtgtgcgtgtctgaggaagagagagagagaaaaagagcgcgagcgtgaagggacaggcgagcgtgtgtcggtctgtctctgtgtatgtgtgtgtgtttgtgctcctgaattcactccctcccagttttcccattcgccttaccatggcctcccatcgctctttagccacgctactccgctgcctcatcctctcttcagctcatccccatcccattcgctgaatctccccccaattcccctccgccatgagccagcccaaacgcatagccgagtacttcttcatggtcggcctcagggacgacaccgacctccttcccatcgaggacggccgtcggggcgaggacatataccgcgacctgggagggcctgccagcgatgcagcccgagtgcccatggtcagggtcaacatgagcatggacaggtcaggagacgcccagagacaggagaacagcagcagcagcacaaacaagcaaaagctggtccagctcaaaggcggacgctcaccgccgaccagccctggccgcgaacaacgagaagcaggcacgggtagagcacgaagcacacctacggttgtatccacggccgctgcgaatccctctactactcccacaacaacaacgacaacaacaacaacaacaacaacaacagcagcaacaaccactactcctactactactgcagcgccagcatcagcagcaagcagcacacctacaccttcaactacaaccatacctacgcacaaaacaatagcgtcatcccaaaatacaaatactacctcagcagccgccgcgttacctatgactgactggcccacgcccagtgaagcatactgtctgctcagcggtcccaacacgacaaaggtgcctaacagagcacgttcgcagtccatggctcactttcggccgccgactgtgcctggcttggaccaccaggacatatcagctcacagccaacggggtaagcctctccttcccgctctattatcgttcgctctcacagttcatcttgctctctgcatctctctgctctgtgatatcgacgagatgctcgggccccaaacaaaaggcgaaggtgcagcagcacagtgtcctgattctgattgcgagcaaaatatgttcatttcctcgtcataggacagcctctcgcccgcccagtgcggggaccacgacgcttgagtgcggcctctatgataggacctcctcgacggacagcaccgcttggaaacgtgagtaatcaaggagccgcagcacttcaacaaaagccaaactaccgccacgtctcgcctgcggccgtctacaggagcgttcacgaagggcaggaggctgacaacagtgtgagtgagattcgtgacagcagcaatgcggatgacaaggattggcgagtggtgacccacagacgcgctggatcaggtaaacagacatccacatgcacgctgtaaaggctcagctcaattttgatcatggagtaaccaattttcgttcaatgcgactagtgatggtcacaggtaccaaccatgcaagtaaaccgtccatttccatacaggatgtaaggagtctgacgtcgggcaaaaacgcggccttggcaaagagcaggacgaaatcgcccacgcctggctcgggaccaactttggcaagggacattggtgagactacgaccaaacccaaggatgtccatcctggagagaagattttcaagcccatggtcacttgtcgctatccggaaaccgactggaaagacggagaaaccttccctacatttttgcccatggtaagcaaccattgtttagcactgcgatttgcgtcctcgagttgaacgcaagcccatctttttcttcgaccattctttttttttttaaccgtccgcacacatccaccttatacacagttctgcttcccggctgagctcacattcaagctatcggatgaacggcccgcgaccacatatcactcgttcgtactgacgcaggaagtggggggcagatcatatgccatgtgcgtgacattttacgaacgtccaccgcagcgcatgctgcggcagtttgaggatctctgcgataagtggacccatagccatatggtatgtacctcatgggggtgttcgagatgcgtcgatgttacgactgattatacttatgcaatgtgcttccattatagtctgaaagtgagattgagtatgccagggctatcaaagacaagatatccaaggaaaaaagcaccttaagaagcttgcaaatacggctacgtgaggaacggacgatggggcggcgttcgaagcaagcgcagctcaagcgggagattaccgactcggaggagaagctcagcttgctcgaggaccaaatgaaaccatggaacggactttttgtggacactgaagatgcatggataccgcggtgcgtcggaatcgtgagtgctgtgccgtaccattatctcatgcgcgactggcttctggccgtggttgtggcgtgctccggcggcgttgagcacccgggcatgagcctcaattcattgcgcctagagaggtatgctctgctcgatcaacagtacaatcgattatctcgatttccgacgtgatccattgacccttttcctgcatctctcagctatgtcaagaacttgatccatgaagtcagcctgccgccgctcggcaggctggaggtgggcatcaccatcaataaccgagtactctatgcgtcacggccagccctcaacagtgtacccatcgtgaagaatgtaagggcaggcggacgggcaatgcattaatgcaaatggtcagcgctatgaagcacaacgattggcgctaaccttggctatgtttggctgtcaatagttttcattgtttccgctgtttcgctgccttactgccgaggacattgtcacggtcatcgaggtttgtagctcccaacattatctcgtccgcagtggccacagaggaaccaaccctgcatagaactgacaagccttcacttccgtctcatctaatactgtccgttacaggtcattctctcggaaggaaaggtcatttttctctcgtcatatctagccatgttgaccctcgcaagcgagagttttctctaccttttgttcccgctttattggcaaggtgtttacatccccatccttccctcgtcactaatgacatgtctacaagcgccagtcccatacatcatcggggttgaacgccgctgttgtgattccgagttcccaccggaggaggtaataaggcaacaagaatttttgcgcgtatgacatgtcaacggccgttactgacaaaagcctttcgacataggcatgtgtcgtggacctggataagggcactatgaatgttcagttggcgcccactccccttcctcctcgtcaacgacgaaaactgatccagtcactggagcagtacgcgcccacatcagccatcaaacgctcagctgctatacacaatccaatgctcggtccaccagcttatgtcaaggaagcatttccccattcgcggctgactctcttctgtggcgtgtcgcgagccccacggtggagtaagcgcgtggaatccacgctcactcgccctcttcccgcagtcccaaatggaagcaccaacggacatctaccagcggaccaaaatggttcgcctatacccaattcaccggcgcttattaacagggcgggatcaatgctggatggttttcctgcattgtcgacaagccagcgcaatcaaagggcgtcagacgtcaaggctgctgttggtggcatgacgaggtcagcatcggacgatattttggataaaagcgctgagatcgacagcaaagattcaaagcaaacgcaggtgagtgtcatttataatgagagcaatatgcagaaccactgttagtcatcgcagaagaatattgacaacactttcctcgccggatcgataggagtcgttgtcgcgttcaaactctgctcaagagccgcaccataatgtatgtgtgtcctgcggtctctcgaccgacatggcacattagtgcaccagttcgccaaggacttgactttccatgtatacctattaatcactggtgtcgatttcaaattcattcaactagaacacgcctgaatcaccacgggcagctggtcgcaagggaatgtcaccaacaaaagcacgctctgccatattcgattcacataagaagctggagaacggatttggccacccaaacggaggcatgcatccaggaataaaccgacacaacagcagcagtagtcctagcacgcacatggcctttgccgccagtggatatgacggtccaggattgacgcaccgcgcctcattcacctctatcgactctacaacatctagcgtcttttcaagatctgcaatgacatctaataccatgatcagcatcaatggaccgccatcttctaccacctcgagtccggaagacgatggaccagtggcaggagttggcgactctagtcgctcggctcccacaaccattgaaggacatgtcttgtcgcccgtcgctacaccggttcctttgcctttgctgacctgtcgatgcggtatctgctcgagaggtctcgcggcttataatgaggtctacagatgcgagggctgtgcactgtacgtgcacgcaggatgtctggacgaactcctatatccttgtgttccacgcgggtttgatgagtctggcgtttgctggagcatactgcagatgtgggctggacttatgaagggctatcgagccggcattatcgctggcgctggagcacagcagcatctgcagtcgccctcagctcatcaccatcagcagcatcaagttctttaccagaaccatagcacccgagtttacggccatgtgagacaaccttcaaacgcggggagcgagaacgagagagaaagtaaggatcgactgtcttgggccagtttctcgagatgggcaggaaggaactctggatccaacggcgtcagtaatggtaatgcgaaaggatcattctcgccgccgaaccgcgcctcgaccaatgtggaacaaattcaccttcagcaatccactgcactctcgcagcgttcgcaagtgattacgcaaccgttggtccgtggaagaagcggcactgaaggcagtacgcacagcgacactgtcagtttccaccgcgatctgttcatgaaaggggttgacaaagaagctagggtaaggtttacgcgagagtgggttagatgttttggattccagaccagagagattgaccactcgttcactatccacttttgctagccctttatgtcggtgtttacggagtcgcaagcattttcacagtttgtgcaggaccgcatggaccgctctcctaccgaccctgagatccggttctttgacgaggtcatcaaggccaaaatcaaccggtcccgcttccggatcggcaaggaggagaccaagttcttggatgtatgcgaggccactttgtttttctccttgttggagtgcatgagcatttagcagatattgaccttttgcacgatttccatcttgaaacatgtctttgtaggacccgagctacggtgtgcaaggaacaaagaaggcggtgcccccttcgggcgatatccagatccagggtaagtgcggttttttctcaagctgctgttccaagcctgtctcgccgttggatgtggctatggatcgcgcgctgactcttttgtttaattgtcccttcctacgtttctagaaagcgattcgcggcggttccccaccagtcttgaccccgcgtttatgtgattcaaacaatacagcatggcctgctggccaatgatacgtcacagacgcagtggtcatatttttttttgttgcttcgtgaatcgagcaggattcgaatccatcgctctcctccagcattgtaaaatagcatcgacacagacgcaggactctgctactccaccttcgctgtcctttcttttcgtcccttgtcaccatcctctctctctctctctccttcttgttctctttttctctcgttctctgatcaccttgactctcctcggcttctcccctctgtattcgtccactccatcatctgcccgctccatcggcctttgccgtccatccctgtactttattttttcgtccttgtcccttctcgttcctcgtgtactttcctgtccgtgcccccatcgtcggccacttgcatgctgcagccagtagcctgttgttgttgatctcgaaatacctctgcttgtacttttctgttccacctctgcgactttagtttatatttttttttcttccttcggaaatcacccttcttaccaagcaacctaatcgagcgcagtagccttcatctcggactgatccatctctccagacaactccttccccgcctgctcttccatgaaaagcctggccaaagtacgtacttttttttcggaactatcaaacactctgatgcctctttgtgctgatgcaccgcgatgcaccgcggcgcgatctaaacagcctatttctattgatccttgacagacctacgacccacagcaagggccggctttcggacaactaaccagggaggatatcagtaatgtcgtcaagaagaacgatgtcgatgccgtatgtacaattatcttggagggaacgggcgggccgcaattctcatcggacctggtggagccaaggacgtgtttttgcagcacaatgcatctgatgactaacgtctgttctctgttgatctgatgcatctacaggtgatttggtccattggaaaacgacccaagggtgagtctggaattatacctccggggtatcttaccaaggcgtggctccacacgttgctaacggactttgtcacaaactcgtttatgtttcttttttttttaccgacaacagctggatttccctcaaagcaatcccttttgtcaggagacgcgcaacggcaggatggcgcagtcaaggcaccgtcggaacacccttcagtcccagctgcgggcgtcactcatctcgtcaacggatctggacctatcgccgcagaggcagccaacggacagccaacagacgcagcagcaaccgcggctgcagagtcttcaacacccgctgctccagccaaaccaaagagctgggcagaacttgttcgacccaaggattcagcctcgactggacttgcggtggtcaacggtgctgctggacaaaaaccagtggacagcaagtctgtcaatggggccaagtttgatggaatcgccgacgtcctccacaaatacaagcccacttacacctccgcgctcatccagccaagagggcttgtcaacaatggaaacatgtgcttcatgaatgcggtacgtgcgtcgattctggacaaggtgcacaggatgaacagccaatgaagctgctcggaaccgtcatcactcatcccacagcgatatctttttcatccttgcgcgctttagattttgcaaccgcttttgcactgcccaccattctataatttgttgatgcagatcgggaagtacgttgtgcatagcttcaagagctccactcccttggtcgactctttgtaagtagccgtgtcacccgccatcaaagcaagatgactgtcgagagattttccgagaaaccgcggtgacctcatgcgactactcaccttcgaaaaaaatttgtgcttataggatcatgtttttgaatgaattccatgtttcgaagaagaaccagccggactatggagcacctttcgttccagagtacgtttatgacgcagtgcggggactcaagagattcgactccatgaggggtcgtcaggaggactgccaagaattcatgggatttttgctggacggtcttcatgaggagtttttcgcggccatgaaggagaagccgccaggatcagcgagcaacgggatcttggagcacgacgacagcgaaagtggcgtcagtgaagatgaatggatggaggtcacaggaccgaagaacaaggcatcccatacccgatcgactcaattctcggagacacccgtctcgaccatcttttcaggccagctccgatctattcttcgtatcccctcacaaaaggactctgtcacgctcgagcccttccaatccctgcagctggatttaacacccgacaatgtagtgacgatcgaagatgcgctgctgaactcgacgatccctgaggtgcttgatggattcacgagttccgaaaagggcggtatcaccgtggaggcgacaaagaagatcttcatcgagcatgttccgccagtgctggtgctccatctcaaacggttcatctacaaggacggcgggacgcaaaagctgcacaaggaggttgggtacaagactgtgctaaaccttcagccaggtaacgcgggggaggtttctgtcttacgctttggttgcgctctgtgaaagatgatttcaaacacggctcacactgacatgatgtatgccattaatgatttttttagagctgatttcgccctcgcgtcgtccatccagcgctatcccctacaaactgtttggcgttgtctaccaccatggacggacagctgcaggtggacactatacctgtgatgtgctgaggcagaactcggaatggcttcatattgacgatacgaacattacggtgatcagcgaagcggatgtgaccgtggaccttgacagagccaaggacagcaatggatacaaccacactcaccacgcccagacgaatggaggcttgatgcccggcgaggccctctcagaatccgccgcccttgcagcagccctgtccgcatcctcaatagcagccagcaagtcgagcgacggagtggcctatgttcttttttatatccgaaccgaccaaaagaactcggctgcctcttcctctggatctaccacacctacctccactcaacccaaaccaccttcaacagcatggaccactcccaaaaagtagacgatcatattttcaagagaaaataaaagtaaagcattgcagaattatacaatcatattggtcctagtcaaatagtccatttgagtagggccattttgttttatttttggcggctttctagaaatcgggttaggcggtggcaatctaacggtatgaagtcttggagggttgtaacccccggcccaattcatatctcgcattttgcgaacaggttgtcaaagaatcgtaagccctcgaccgactcatccctacagatcaagccacgggcctccgccatctaaagagacgcgcagcgcgaagaagacatatatggtcaagacaaaatcaacgtccatagctgattgtcatcccatactaagaaccggctatggatacatggacacttccggagacaacacacacacacacacacactcgctccatcccacgcattcttaccaaaagttgatcctgagccaaggcaacactgatctgaatagcgctcgccaactcgaccgccgtcagacctgcccctggcggaagttgttggatccgttcggcaatcgtggccgaaacctcatcatcgctgtatcgggccagggtctgaatcaccaacagtccactatcaaactttcgcaaacgcaacggcaggttcagctctggaaacatttggcatgccgtgtgcagatcctttggagagatgagttctgatagccgttgggggagaagagagtgtaggaaaggagggaaagggatgggaaaaaaaggtgtgagtggttagttcagcgctgtaatagaaggtcctgatcaatgctccagaacacgagtaaactgcaagttcgtaagggtcattaccaactcctcgtgcgcgattaaatacacaataaatgtccattagactcatggttccgccctcccgctcgacaatcggaagtatgaattcaaccagctcgcgagcaagctccttatgaaacacggctccagcggtatccctatcaataccgggtgttcagtcagtacggtgtagaaatcagctgcagcaagccttttttttcagaggtgttaaaaccgactccttactttgtcacgggtgcagcgatgcccatgctcaacaggtacgtcttgaatgtggctgtctcttcgttgttcatcgtgtctgagttcgcaagtcggttagagatcgtctctgcgagagctaccatctcggccgccttgttcatcaacccttgcagatcctggaatgccgttgataacgtttcgtccgtcgcctttctgttggtctctgcattccgcatgataccgcctagtgacaagaaacaataaaaagtgcaaaaacgggaatattaacaaatcctgcacgattcgaaacatgaacgatgaacatgaagcccattcccaggtgtactgatccacttactgatgccgccaaccttcagctgcgcaggcgcttgtactgttcctggcgcctgtgaggcggatgaattcacagtggccagtacagggcgcgactttgatttgccctagtcatcatgagagtgatgcatggtcaatgaattacccatgaagcatagtcgctgtagaaaaaacacaaaagcttgtcaatacctcccatgccttggaggccatagctgtcttgagctgcgaatgaaagttgttactcccccctgccctgaatgacagcttgacgctattagcgtcttctgccgcggtccttgaagacccgctgctcgatgacgttaagctgtaaaaattcgggagactgggcatatatttgctacccccaaaggatttggtcgtgttggtgttggatgggcgactcgggctatgacgcgccggcgaagatgagggcgaaggtgaggaggatctgtcgatcgtagaaggcagctgtcgaatagaacgctgatgttgctgctgccgatccagcataaatgcgaccgaattcgcatcctgaagctccgtaccgcagatctcacactggatcatgaaagggtcgttatgaaacgtgcaggcaggacaggcaatgcccgaatgatccgatccagtggtggtagaagtgctgttgttggtgttgccagacggattttgcggttgctgcacgattgacgctccttgccttttactgtcagagttgcttatccgctctggctcactcagtaggaagggatcggcggcgggagttgtcggtgtctccagggttccttgaggtttcttgacgccacatacagcacacttgacaatgccgccctggttgctatgatagcagattgcgcacacccaggatggctcactcttcagcgagagggctgccatggacgcgcccagtccagaggtagcaccggtgagagatattagatcggatgaggactgaggatcgctgctagtggaacgagggtataggtccaaagtgatcttgggtgatgacgacatgaatccgccctagagatggtcgaggcaaaagagatcgtcagcggaggtgtcaacaaggctctctggtgtcctggcatcagctttaccctctaccttacatagtgctgaatgccgtggattagacggagcggcaatccgatggactttctcacaggatcttttgcatcgatatacagtatccgatagcttgtcaggtatacagttccattgggatagtcctctgcttttagtcgactattacagaagcttctgaattagaagacaatggcgagagtttgcgtgtgcttttccaacctctgagaaagagcagctctggctttacccatcgtatagtccgacattgtcctgtgtggtctggatggtctcctggggctcaaggactgggcggaacgtggatgtgaggttgatggggtcccagcggtccatgggggatgcacacggtcgttacacgcaacctctttcttttttcagtcgagggtaggaaacgcgtgcgtcggctctttaggcgctgcttaagcctatgggtgtgaagcgacttgaagaattgggaaggagacgagacgaattgcagaattgcatgtaggttggtggccagctagctttatgtgactgtggcatgatctcgttttttttttgccgcattgtccccaagacatcgaagcaccatactttgtttctgtactcccctgtggacctgatctcactagcttttgcatgggtttgaaagggtcctaaatgttcgtactagtaactgcaacatgtcgatctctcacagccaagatgtccacagcaagtcttcgaaatgcgtcgatatcctgtaggctgagctttgagcgaacacatgcatccagtgtctgaatagctaacgatacaagtgcatgctctcgcagcaagttcttagcgccagcagaaaaggtcggcgcgggaggtgtaggcctgacgaggatcttcttcccagtcagggacgcgtgaaaagattcgattacttcttgctggtgtgcttccagaaactttaaatttgtccagtgtgtcagcaaaccttgctctcctcctcatctcggaactccaatctccctcccccaatctaatcgtaatgtcttccaagcgggctgccgtctcattcaccggtggcaaggactgcaccatggccctgagtctaacgatggccacccacgaggttgtccttctcgtaaccttcggtcccaagaactttacgtcgttcaaggcacactcgctcgaggtcatcaagcttcaggccaaggccttgggcatcccacatattctcgtcgaaattggtgaggaaggcaagactcatctagaatgctaccgcgagaagatatcagaggtcaagcaggctcacaacctcgatctccttgtcactggtaagaaaacccccagtggagagcccctgtcatgtcatcccccttaatgatcgatgttgcacaatgcgcgagaaccagagagaaattcatgctgtcttgaatacttgaaaaaaaaatatctaggcgacattttgaatgtctgcgacaactttatggccagggccacacacggcatcattgaactctcctgcccgatctgggaaattgaccgccgcaaacttctaggggatcttttcgatcgtggattcgagctcctcatcacctgtgcctcgatcaagaagctaggtggagacgaagacttggcacgcaagtttgtggggtccaagctgacgcgggtgtttatgaaggacatgctagagccaagggaacaagacgtggacatgggcggcgagcaaggagaatttcacaccatggtcctcactgtgcccgggctttacaacggattccgtatcgattatgatggccgtcaaatagtggacggcgagtacatgtatttggaatttgaaaacgttaggttagttcgtgacgaatagccttgaatcgacagttcacatccgatgacagaatccatgaaacattcctctgcacaaaggcaaacatctcatgctctgcggccatcgagagattatctaaattgcgtttatttgtgcgcatagcgcctatgtccgttcctgtgcccgtgttagagattccggtatctgtgtgcttgcgagcgccatcctgcctcgcacctctagttgtatatcgtgttctcgcgaaggtgaatgggggtgtttgatgcgccaggaatgaccttctccaatttctatcgcgatgaacagatgaaagtaagtcgaaaatcagtatcgatgatacccgtaggtgagtgatcgcataatcgacaaacgattgattgaagtcgatttttaccagcttggagaacacgcattcgttcaaggtcctctcaggcttgcggcatgcatagtactcctggttatgcttctcgaggcacttgtagtgggcctcccactccttctcacagttctctctcagcttcgtgatcctaaggaacaaaggtgagacagacatggtaaaggttgttagagtggtgcgatcaaaaaagacgatcagctagaaaagcttggatcttgaggcgcacgattcttcaccctatatcgcattgttgtttccactgcgtgccagtgaaacgcgagaacaagacttacaggtccatagcgcagcgcgtgaccttgcggccctccttgagacagtgagcaggatcgctgttctcattcttgcacagcataaagtcctcgttgtagtccttgcagtacgagccgataaagaacgctgccgacttgaggggtgcagacgtggtgccaacctctgggtgcgcagcctcagcgggcgcaggagtggggtccacaaaagtgccggtgggcaaggaagcttcgcggtaggtggccattatggtttgattctagcaagggtgggtccacaatgaagattgatccgtaagacatgattgtccgatgcagatgatccgaagtccgattgggaattccgaggcaagcggacagaagacagcaggtgctgttggtgccgcgactctctcgtctaggatgcagtgcagaggtgttccatatatacgcgcagatgacatactcgagcctgtgcctgggtgctgggtggatggaagaggtgaaggtgcagaagcaaaggcgaggtgctgtccgctgcatgttcggagggacaagcgctaagagttgcctaagccacccagccctccaaaaatcactcccctctcacttgcctgtcctcacagtcctcggacccccttctgaggtttgccacacactctcacgtccaaagtcaaaaaacgagaggctcacactcacacagcacagggcaaacattttttttttgtggtccttttgtctgctccttggccacctttcgcctgaaccccactccacctgccgtcttcctcttccactgcgaccgctcttccgtatcctcctcctcctcctcctcctctaccctccttcgcgcttccttgatgtcgcgggcgagcgaatgtagcagcgaatgcagcaacggctcatgtagcagccgatgcagcagccggtgcacaaacaggaggtcgtcaagcgtgtcgcgaactcccttggagatggcattcgctcgcgattcaagtgccattcaagactcactcccgtcctcagacgcttctacggtagcaactctccttgttgaagaaacttctttactcggctctgtttggaatcttttcagggatgcaaaagatctggctgtgcgggaaatcgacaagttcatggaacatcttccctcccgagggcattcccgcgttattacggccacgaccgaggtacgagaaccttaccaacaaaggcggacacgggaaatcggcgctttgtatcctccaacctatatttacctttccctttactggtatctaggatcgacgactggccatcataaagtcagggctctccacacagtctgccagcctgccctctgtagcgcccccgaaatcactgctgggacacggaccgtcgattaagcagaagggaacgacatcaaggtccaaaagccatgcacttgcacggagacttctcgaccaaggtaccaataactttctatcagtttgattgtgcgctgataatgctggatcggctttgataacctatgacccgtttgagtagatattcgattccaagtcaacgatctttcaccctcagtacgacatgacatgcagtttacgcccacgcccactacagatatacaccatttggccagcaacaggccgagcctctcgaaacgctcgcgaacaaactctggatctggatcctcccttaggacagcgccgagtgtaactgaggagccaccatcgaaaaagactccgacttcatcggcaaaacgcagctctttatactcgtcgtctcaccacgagcgtgagcaggtcgaactgcagaatccagaccgatgggagtctgcaagcgatcatcctcgagaggacatggaatctgatctcagcgactatttgccaaacgaaagccaaaggagtcgactcagtagagaatccagtgcgacaccatctatagtatccatggcagggtctatgtccatctccgcccaggacactagcacccaccggcctcacagtcgacagcgacatgatgcgcagtataggaggcatatgcacccaaaactgcccccttcagcgagatatagcctattgggcgaaattttaacgcgtcccgacctaccgccagtcatttccgcccctgccgcaatatacccaggatcaccagcattccacacaagatccacctcagagagcaggcgcgaggcgcgtgtcaccccctccctgggcgtacctactaccgaggcattagacaacccattcgtaacgtcacgagaaccatcacccgtcccgtcgttgtttgcagatatagcgacacccgactctcgtactcggcaaacaacagccacgtcttcaccagcacttgaaaacgacaccgtcaacgaaatgagacaggagcttgccgcgatcaaggaactggtaagctcatgtagctctcgaggaggcacttgcggacaccactgcatcccaatagccaattgctaaccatctcttctctcgtcgcgttgcgttgcgttgatatcaggtggcgtctttggtatctgcgcgtgaagtagatctccacagggcgaattcctcgccggcccatctcagttcacctgtaccactgcctccaccaccaccgccttctcaaggaacctcaacaccaaacgcttccaaaaagtggactttacctgccaatcaagcgacgcagtctatgcagaacgtcttgcgggagttgagttcctccaaggtccagcttcgtaagacgggaagcccttatgtcaggtaggctgcgataaaagctgcgcccgctgcccagccctagtccagtcgtgcatatttacctagggtcattacactaacgactctgcaccttctgcatacgtagtcgcatttcgtctgctgtcgacggctcagactcctccaaatataccagtgtcgccgtaagatcgatacatgagccaaagacacccaaggatgaggacttcaactatcttcccaagacgccaagtaaaaagagccgacttaatcccagttccgcccttatgaaccttgactggcctagtcctgatatggtacagagggccgactctaaactagaccgtgcagcggaggaactggctacaaaacagccgacactgttgtctcgcctgactgttctagctgatgagcccgaggcaatggcagtgtcttcctcatcgtcgccctcgccatcagcactccaagaggatacccgcgcagctgctcaagcatcagggctcaggaaccggaatggcgtggcagcgcggcttcttggccaccctcaaacgacaacccgtccacgccattctcctttgcagcgatctatgaccgatcctacgcagctgaattcgcaaaagctttcctttaagacccgggagtcgcagcctgttacagacagcaagcatgtatcgttccagtcattggcagaagatctcgacaacgaacgccgatggtatttagaatcagatacggacggatggcgtgttagccagtgagtcgacccctgtccttcattttgaagtcctgtacgatacgccccatccacttgtataaaaacatctgttctttattgatataccgtctcccgctttccgcaaactgtgctgctctcgttggctgccgagcgctgttgtcgccctcctcagagctgtctttatgacaggggtatgcttctcagttcggtgtactattcgcctgtggggtccatcctcgtgcgacagtctacaaggacttgttcatgaactttctcttctggaaacacatccaccactttccaggcttgtcgttctcatagatgcggttggggagtcgcacagccatctcctggcgcaactgagtcaagtactggcgcaataggtctacaagcatgaacgcgggagtgatttggagtgataagtaccttgatctcgtggcttcctccaccagaatgtgaatatgaacgcgacggtcgaacatgaatgcgcttacctgcatccatcttgttggtgggcgaggcatagagtgcgttcaatgggaaggtggcatctccagggatagcaaagttgccgaccgccagtgtgctaaggatcttctctgcctcccttaagctggggttcctggcaagcttcccaagacactctgtaatgaagaggatcaggtatatgaggactctgtcggcgtcgcctttgatttcaaagttcctgaacaaaacattggcgcggaacaaattcagggcttcgtcgatgatatcctcagcgttcgggtcggcttcgcagggtgaagtaaaataaaaagaagagaacaggcaacactttgaattagcatagctgtgcaacttgcgattcgggattatcaagcgagccttgctgcataccaatggaagcgggtccacgagcacgagtcttgatgggcagaagggccatgcctcccacggaacgcaggtctgtcacctcgttgaatgcagaatggtaggcctagtaagccgtgttttgtaagaaggaacgatcgattcccgggtcagaacaccgatcctctttcgagctcgttgaagcaagcgtcgtcgttttgctgagaagactgcattcaagcggcgaaatctcgaaaggcgcatgcgcattcgcactcgacgcgcacgcccggtactagatgcacagactggggtctctaaccaaagccgcgcacttacaggcatgatgacgtgtcgagctgatggtgatggggtcgtctatacgcgggtgcgatggataatgttgttggcaagtggagaagtgaggagggaagggtagatgggaaggaagaggcagaaagactcaacagccgttgaagtgggtcaaaatacgtcactagaacctgtgtgggatcgaatccgagcgggtgcatcttcgcacaaagtggagaaaaaaaaatgcttcacaacaaaaaaaaaaaaaaaagaaagatccttctgcgctctcttccttctccgtctcattcacacccacacatcaccaacctccgcgcttcccatccaccgccttctcgctcgctcgctcgcctgcaaagagttcttttctttggccgtaacgctcttgcctgcaaccgctgtagagacaggtgagcaacacacgactgtgcctgacgcgccttttgtgtcgccactcgaccttttcctttctcggcgaacaacctgtcactcggcgaatcggattcacctccactttgctgccctttgtccacctccaaacgcgcagtctcctatatgcaatgcacccacgtcctcacccccctcgaatgcctctgcgtgccgttctcgtgagttaacaagctttatttggctcattcgtgccactctgtaccgttgtcgtagctctggcactcttgcttcacgccgtcgaagcagctgcgtcaaacaacgcataggcaaggaacgacaacactcctctgtatcttgacgtgagcagacatacctcgaccttcacttctgcaattccgacaaaggctcgggatctgatcactccgctcccatgctctcaagcgttgctcaagggctggaggatgtcgacacttcggcctcgtttgcaatctcactttcggtcgcgccaatgagtgcgagcagtactattcacaacattagccaagccctaggcaatggcgtggagcacttgtctgctgaggccatacctgcagcacagcaccaccagcagcccgaagctcgtctggcagtggcagagttattggtctccctagcccatagctcgcgatcagcagagtaggtccatggatcaaggcactgtcagcaccctctcttgagctctgggctaaccctgtttcttatcggctgcgaactaggctcacggattcaaacggcacagatgtttcctcagtggccacagagttggcagagcaatcacaacattcgcccatctacaggagtgccgtggactatgttggattggtgaggaacgcgtacgaaagcaatccacgggtgtactcagagttcctggatgcgcttgagaaataccacggcatgaggtaacttcaggattccgtcgcctcaagtataccataaagcaggtcttttgcacgcggccgtactaagacgcttcccatatcaatcattcgccagctcaaccatagaacatcttgtacggacagtgatgaccctcttccaggatcaacccgacttgctgatgggcttcaaggagtttttgccagaggcgcagggcttgctggaccagctagtgccggtaacgtgtttgaacaatcgatatgagacccaaaaccagtgacatggagaactcgacgctgaccagcaaccacgcgttgttccttacaatctccctactcctacttgatccggcctcggactttgcgttgatatcgtccgcccgtatgatggtattatgataacagcccatgatgtactcggactacaaggccagaccagcaaaaccagcagcacaaactgcgtatcatacaactatacccacagacatgcttacaccgcagacagcaggtactgttcctcgtcatacatttgaggtcattgtttagatttgacgggcactgaagcgcgtggtttcgtgcgctgtgaaactcaattgattttgttttccctttaaggtgatctagagcaacctgagcaacaagagggagccaacagtgggcatgccgctgcagatttcttgagcaacatcaaggtatgaccaagtaaatgaaggataaatatcaaagccgtgaaagtgagagtgtagatgctgatgagacagccacgtccgcaacctttttgttcttcattaccctcatcaggagctctcaaaaggcgaacccgacatgtaccaacacatgattacgctactcaggaagtttcagaaggaccgctccttcactacggtaagtgaagcctaggcatcatgcataagaacgtccctgtgtagaagcccatggctcatgatcgcctcagcaagcaagcactgatactatgctgcatatagctctatttctatgtatctatcgttctgcgttaccacccacatttgctgcaacgcttccatactttcttgccggcagtgcccacggatgtggaggtggcagaagcaaggatcatctcaatggcccctcctgaggagctggttgtttctccagattttatcgaggcaaaggactttgttcaaactgtcaaggtatgtttgaatactgattcgaggcgtgagaatgtcagttgcgagtactggaagctaacctactccctggactaaaaaccacctatagcacgaggccaggagcgacatgtcaatgtatgatcggtttatcttcgcgctggaaaagtatcagcggacaggctggacgatcgatcaggtatggctcgtgagctacaaagaattctcgttgaccgtcttgaagactcaatgctaaatgctctctcttgtctttatcgcaggtatactctgaagtgtcccttatattctggaaccatcccgaggcgcttgcaggattcaagcagtttattaccaccctgccacagccatagcatcatcctccctttttttacctatcattcctataaatgaattcatctcgcgcgcctcgcgtcctcgtagttgaaaaacagtcacgggtgacgtgggcagtttccagtttcgattgcgcgtcgtgcgcgtgcgtttgatttacctctttgtcctgcatcaccttctcgccattcccctcactctcgagtaatcaaccaatttcaatcacaaaacctccaatatgtttatgacacgctctgaatacgaccgcggggtcaacacattctcgcccgagggacgtttgttccaagtcgagtacgccatcgaggccatcaaggtacaaaatcattctctgctacattcaggggtcgttagctcattactagaactgtcgctgagcagacgtgtgagaaccagagtactgacagaaaccttactgtattcatacgctgtgctatggcaaaaaatagctcggctccacagcagtgggtatcaagacagcggagggactgattttgggcgtggaaaagagagtgacctcgtctttgctggagcccagctcgatcgaaaagatctttgagatcgatgctcatatcggatgcgccatgtcaggacttactgctgattccaggacaattgtcgaccatgcacgcattgaggcacaggtaaggattagtccgttctcgtatgacgatgttgagacatcatgagccatcgtgtgaatagatcactaacctctctctctttcaccgccactcctcttttacatatatccagaaccatgcattcacatacaacgagagcatcaaggttgagagtgtcacacaagcagtatgcgacttggctttgagattcggagagagtgcacgcggagaggaatctatcatggtaggttttaggatactcactgggatatggggaagaatggcaaactacaatgtgtcgatcgaccggttggcctctttactgacctggagatgttttatatttttggtccttgctcaatctgacataacagagtcgcccttttggtgtttccttgttgattgctggaattgatgagactggaccacagctgtaagagtttttgatgtgcctgaaaaagcaatccactttgccctgtcaaagacgctgtcatgacttgacaaattgaatgagactaaaatacccttctgctccttgctgactatttttgccaatgacaggttccatactgatccctcaggcacatttgtgtcgtacagcgcaaaggcaattggatcaggatcagagggtgcagagacagaacttcaggaggagtaccactccgccatgactttggccgaggcagaaactttggcactaaaggtcctgaagcaggtgatggaggagaagttgaactcgaccaacgtccagcttgcctcggtgacaaaggcaggaggcttcagaatttaccccgccgaggagctgcagcaggttgtggatcgcttgtagaaaaggccagacaaaaaaaacgatacacaaaagaaaaagtgacggccaacaacaacaagagatcactgtatatcctcgaatgaagactgtaaaaatgcaaaagtggccagaatatttttttttgtgaagcgcaacgtcgttttattgtgcatgtgtgcttccagaaaatgaacacggaaggattgtcgaggttgtgcttcgtttgtctgcggagagctgaaccgcttgtctgcgtcggacacgattgcagcgaatcgttttacttggccgcatccttggccaagatctcgtgaaccacgttgaccttgtcctgcatggtctgcccaaccttgtccgtcctggttccaatacgaacactattacatggttgtttcaaatcgcgttgacgtatgagcactttttgacatggccatttgtgtgatggtatcaaaaggcaaaaaaaaaaaaatggttccttgtcttctttcagttttttttctttacctggtcgaaactctagggcatcccatggcgtgcacagcttcgtggcactctttcatgactcggcaaacatcgtcccactcaccctcgacgttctaaggacacggtcatgcgtcaggaagaaatatgcatcagtgtcagatcccttttcccgtgagaagaaaaaacgaaaacgttccaaggtatgtgcacccaactgcttggacgtacagttccgtaagaatgcatgctgtaagagagacctatacacagatcattcaagcagatcagtccacattgctcggggatgagaaaccaagaggtgacacgacgatccgacgcgaacatgtttttgcggaatggagtgtgtgtggaggcacaagaaggaggaccaccgtcttaccgctcttctcgatgacgcgttggcactcggcaatgtactcgctcacggaggaggtgactcccatagggatgacgcaaaagtcggcgatggtgtgcatgctgggtgttccttgtgatgtctctttggtgtgggaggtgcgcagagtggaaggggagcgaaggtcggggaaaaagtgcgcacaggtctcctcgagacagtcacgaagctcgcagaaaaaaaatcatcccacgcctaggatcgtcatcggaaacattgcatatacacacgtcctcgtaacttctagctgaattgtttattgagggtcagtgattatgaggactagagtacatcgcttgctgaggtcagtcagttacgagaggaggggcaatggtacaatgagcgaaagatgcgcagatgaaaagaaaaacgggtattgggtggagaggtgtaacataatgggcaaaagcacgctggatgcactgggatagggtgcgtctctcgaccctcaagagcaaacaaaaaaaagtgacatggaaattatgacgaggtagccagggagctgatcccttgcagacaacaaaagagtgaggtgtataggttatttttgtacaggagaaagggggttgggctgtgcgttgcaatagaaaatagtagcaacgcccaacgaatgcaatatgtcaaccgcccataggagagacgatgaaggggggaggccgaatacagcccctccgtctcgaaggaaaaaggagtgaagcaagaaagaggctgagaccgggtcaaaaataaagggcgcgcgtggctaaaggaggcagtgaggtcaacaacctatcaccccggttttttttttaggccaggcaaggcatgttctccttggatcgatgaagctcgttgtggcgatgcatcatatcgctagtccgaagcgtgtttagaccgcgaagttcgctgtcgtattcgtcgtcgtcgctgactgaaccgctagagtggccatggcgtgaaaggatcggtgaggagccacaggaggctgatgagggatgatggttctggaagaggcaaggcttggattgccttggacttgatcccgagaatgagccaggaactcgagcctcgtcagaagaataaccgtcttcttcagagtacatatcgtgctgcgattgttgctgctgctgctgctgctcttcttgctgcatgcgtcgtttcatgtcctgcttccagtcgatgcggagttgcatcaactctgatgcctctgagaaggtcagctttgctggctcgagcgcagttcgatcatattcgtcgcaaggatatgtgaaagagattttgatgaacctcgagaactggacagacttgctgcaatggttggtgctttccatcgcagttggagaggatggtgctgatgtgaagggctgggtcgtcgtgtgtgacatgatggaccaagggtggtgctacgctcagttttgatcgagaagcgttgatgggaaagaaaatgggagccaaggatgtgcgcaagggagataaaagggaagagctgtctcttatggccaagtgagagaaaagaaggtgcagagtatgaacgcgggggttggatttttatagtaggccgcacagagggaaaatgacggagaatcggggtcggatcccaactgaagactgtcgcgcggctgaagctgacgtgaacttgctgtgtgctcgttttatctagcctagtgctgtttctgatgctcgatgacgacgggatctcgggagggaattggcttgatgatggtttttttggagagaacgggagtggattagaagctggtgggttgtctgttggagtgtgatgatgcagactggagggagcagggtcaagggagcccaggaaagagtagtaaaagaggagcgtagtgcggtgtatgatgtgtgttgatctgatatgaaagaacacgcagtaggggtgcttgaaagaaaatgggaagtagggattacacacggctcaagtgtggatggcaaaaaggggtaaagggaagtggtgatgctatgaccgagtctgctgtgtggcaagtgtgtatcagatagctggcgtgcgtctgtgcctgtgtgtgcgagtgtgtgtgtggcaaaaggagcaggctgcgaatgtgtttaggaagagaaaaggaggatatgagaaggtggaaggagaagtgagaggcgggggggcgagtgtttaagtactcacaccattttttttttctcgtcccttcttctctgtgttctgtgcttcgttcttttttttttctcgcccattcagtcgtctacttcaacgcaccacctctccttttgtttatgttgtgtattttgagcgtataggctagtccatgttccgttggcttgtgcgacactgggccgtggtgtgccaaaaagggcattgaatggcatcaacaacaaacaatgcttataatcctgcgtaggcattccacgcaactcgttttgttcactgtcaacagcctccccctggaatatgttgccttgactccaccactattctgcgcccatgcagtaagccccaaataattcaatagagcaatcattcagaatttaccttcactgtgtactcgatgatggctgcgtgcaataagcgtaagacagacaaataaaggactacagtgggcacgacatgattaataaaatatcactaccgaagagtacacactgagagttcccatcacgttcaagagttcaagcagagccatcatgctgatccaagagtgcgaccgctccagattaccaacagcatggagtttcagagggtgtcaacgttagaagattccagctcacttttgttttgtttaggctcgaacacagtggttggtgcaggggacgtcttcagactatgctgatgagagaaacattggatatcggacgggagaaagggaagatgtaatgggacatgaccgaagggaggcgatctctctgtgaggatgctggagtaacccgatgttgattcccgctgctgtggtgattgagtttgtgacccgagcgtccagacgcaacgtgcaattaccttgtgcgcgccacgccttgtcttttttttttttttttttttgggaagctgtcggtattgctcagggagagaatgctggaagtgcgggtgaggagaagcagtgatcacttgatggtagaaagtgctgggggtctagtggtaattaatgaaagcaggagcgatgcgtatatatagagaaaatgtagcagtgaaaaacagagagacctttgagccctatggttgagcaagtccaaggctagagtttggacgtcggtgccctgcgcgggacttgaacgaaaagacgtgaaaaacgaaggcaactacatgtagacggtgtgcacctggaccagcctcacaaattcattccttgtttgtcgtcgatcgatagagccttgcggaggcgtgcattcagtgctagcgaccttcggcaatgtaaacagttgcactgtccgaggtagccttgactcgacaatatagaagtgtttatttttggtacatttatctaacacgctgcagacggatgagagatgagaggagagggcatggggcaagggctcgcacacctgcaaaatgcaaatctgatgatatggaagaaaaaacacgatatgtaccaacggcccgtggtcaggtctacgatccagacgtgagcactctgagcaattttgtttttttattttttttttttgcggacattcgtatcttgcttcgttccctctagcctctctatccctcgcactattccatacattcatgcatgcatgcatatcgctcgcctctgtcctggattaatccgaagacggtatataccagaaagattgggtgggtcccacgaagttcgatcacactgttcagacagttaatccgtctcctttgacaacctctgtccctttccctgggtcagtggctcgccccttttgagcaacatgtcctctatgctggtggttctggcaggatgcactccttcagacgcgtacacctccctgcctgctgcccagccataagctaaggagctatccagcatctttcagtcctttgcgaaaagttttgggcctgagaagagtgagaagatggcgaattgaaccctccatgcaagatatgcatgtgcattcggcctttgcgaaaaacgcatctttgcgctctacaggcttgtgtacacggggcaagacctcacacatctagacggcgcacaactcaactcttgttgtcctttttaccactcccgcatctcaatacactccatctccagcggccgttcatgcagcctgcatgacacgaggactaccagccacgttgtcccagcacccttgtttgtgccgtaaactgggcccgaaaggcttttgacggttgtacaaactgctttttttgtgttcagtttacctgaaccttgaacagagtttgcctacaagaacagcaaccaaggagatccccattcacccacagtttattttttatagaagacgaggaggaacgaaaggagtcatttctactacgcgtcagggatctgctgcagggcaaccctttgcaagcacttgttacgtgcactgcgaaaatcgcccgttcgcctttttacctgtttgcgctacttgcgcattgtgcaggtcaggacactcccatccatgttctctctgtcaccagttctcatcgctttgaatgcgctagtacctatgaaataaaatacggcaaatactcattaacgcgggcagtgtgttcagaggcacaaatcaacggatacatgcaattaaaagcagagttcccagttgaaggtcatcacggccctcctgtctacaataccccctttccaggaccctgggatattgcctgcgctttttgcctgctggtagtgcggagactacatgaagcgctacgacattgagaatgaattgaggttcaggaataaaaaaagcccctcatgaggcaggaaggctcacttggacgggcgttatgacagcattgcaataaatagacgctgaatgtctcaacacacgaaagcacaggggagctgcggacagataaatagatcgtaagcaaagcatagcgaagtctggctatattcagccctctccacatggtgttggctgcgctcacccctttctctgtctcttggccacttggcactccgtctgctaatttcatacggaaaaatgataatgaacacccgtcttcatttccaaagcacaccacagagatatgacatgaggagctcgtgtggtaaagaacccctcggaggaggcaaggcagtgacgtggaatgctctgtaggaaggtaagcagtgttgtggccgaacggacctttgcatcttgggctttttgaaccatgcgctgcacctttgcgcgagcgcatgctattgtcttgacaacactaatcgcatgtttagccaagcttgctgcaggggtgggatggatggacgatattttttttcttacccttctgacacgccttgtgcaaggcatcgcgttcttatgcagcaaagcggcgtcaatcaaagcgagggttttgtcaacaccgaaacctcatattgtacatgtaggacacagaatcgaaaaaaggatctgcaagtctagcgtcattgttcatccgtgcaggcaagtgtggcacgcacgcgagaaactttctacagtactgtcatgccacccttgtgtccaatactgtgcacaatcccttgccgacgcccacaacatcatcgaataaatagagttttttgaagatggtatttacgaagagcgagagaaaaaaacgcgcttcctcaatcaatcaacattctcatctcataagtacagctcgcctaagcatcgttgctcgtcacccagtcatgttgtgtgcaatgagcttgaacagagaagccgaggagttttttaaaagcatgatgtgcgcttgcgacctcccttacgtcagcttgaatcccagaatgcaccaaaacgcgctgcagacttttttttataacaaaaacgcgttgcagactgtctagggaaatactgaattgtcaggaaataagctcataggcaaggaaataaatccttattgtgggaaataatgatgacgtaccggaagatttgttcacagatacttataattatcggaaggtacgagtcacgtgctccaacctgattggttgaaagcgactttagctcagttgggagagcgtcagactgaagatctgaaggtcgtgtgttcaatccacacaagtcgcaatctttttgcctttttccatctttttccgccattcatgtcagaagaatatctggatgatttgacatgcatggctgccctgctggatgaggatgcgatagcttctttttggctagagaataacggtggagacgagtagcatggggtcacgacttgatttcatagtgcctttaatttagatgaataaacacaggtgggaaaacgcgaaccataaggagtcttgagctatgctggacgctgcgagcaagccaaagcattactgtctatctctactatcacaaaagcggcgtagggcttccacactgagagccattcccttttcacgcgtcatgtccaagcacggctgtcgaacttatcgccgatccattgctcagcctggaagcatgtcacttttctcggcgtctcatgaatgaactgatgaagcgatttttttttttttttttttttttgcaaaaaaatcaaaacgtatcctcttcgccaaggacacttctgtcaagggacatttcgcctttgcctgttcttgcacggcatccaaggtaggggtataaggacagctcccaccctcccttcagaggtagagatgcatgcacaactgcgataaaccgtcatgcacaggtggaagtgacaaaaaaaaaaaaaaaaaaaaaaaaaagaaaagacaacgggaacatttgcttaacatagaccagaaaaaaacactgtgcaatgcagtggctcacaaagcaagaagagtttagggcaggctaatgtgcgcaagaagcatgtccagctattactgtaggagtcgaaaggaaaccccatttcgagccatccactataagatgccatatcctcaacgatgaccatcctcagaacaaacacacaaccaccagtacagtaatcactcacgccccagcttcaagaaagatgtacggctctggaaacattattgctttccatgtgtgctgtcgctctaagggatttctctccattattttatcacagcaggcttaaagtgctctcgaccatcgttgccgggttctgcctcggcaggtacgcttcagttttacctcgtagacgccttcgagtgccgactcatcacacgtggttggacagatacctacacagggtgttcttggacgagttgtggcagtacgccttgcaatctgtgggatgttggtaacgacgggaagctgctggtgtcatggaccaatggctaccctttctcaaaatgtgatcttaaaacttccctagctctcagtggggcttgctgcaaatccgacaactacggtgctccctgctgtgtagggtacaggagactctggtgtggcaattcgcatgataaatcttcctgccaaaggcgacaactagtaaggcgaccccttggaagcactacctatgcaacctgccttcacagcatagaatccatggaataaactagatgaaaactgtcgcatattttgtgaagaatgcgagagatggggagaccttcatacccgatataccgatatgcaaccacagcaagtgaagcactctcgaggtgattattgatagagagagggagagagcgagaaggaagcttttttgaaaaaggcagacgttattaggctttggtcatcggaacttgaaaaagcttaggacttgagtaacatgaaattgagaagtgtttttgatgagcttcagcaagaagaaagttcctggcgtcgtgcgtcgcatccttccggcagcgattcgcatgaaaagaaaaaaagaaaacgaggaattcaaacgagttgtcgctaacgatttgaggatgttgagtgttgaggtgcagcggagtttcaatgaacgaggaaagagcaaaaagaatcgcgtcaactgcagggttcgaacctgcgcgggaaatcccatacacttagcaggcatacgccttaaccactcggccaagttgacagacgattagagcagccaataggagctcgtgaacgtggaacaagtttgagctatatgtagcattggcccttctacgtacaccgtgataatcaattagagagggttagctaattgaacattcaaatatagataaaccttcgtaattgaccatttggaccacacacacactaaaaaaaaaagcacacccagcttattcctcccctgttcttttcttgaaaggtctttaaagatctgccgagcgttcaccgcgcttcttgagtggcaccagagacccgcaaagagcgtttagctgtctcatttagacgttcttggcaaagtttgtcctgcttgtcaatgccaaacaactgatcggctgttgaaagattatttttttattctctggtcggtagtggtctcgcactctgcgctgtcgtgtggtgtgcgagaatgccagtgctaacaagaaagacacgcaggcaaacaggcagataaatacagagagatcctgcttctgtcgagccactgctgctgaatatcactgtcgtcgttccattgccatgactgcatttgcttcagcctcagcttcagatcctaaaaaaaaaaagtgccataagcatactgagtattcgcttctttcaagtattcttcatagagcaccctcttagttgaatatttttcactcaccatatcgtgcgcgaatgaaggccttgagtcggagattttctcgaagagcatgctgcaggtgtgcgctgagagagccacctgtgcttggcaagagggccacatcggacgttgttgacatgaccgtcctggactcgagaatggtcgtgtatgtcgtagtcagatttgactggatctgggaggaagcattgtcctcctcaacctggatgcggacttgagagtgtgcatgccttgtcccagttttaactactggtgtgtggggatgggatccggagggggtcttggcctctgaactgtcaagagcttgagtatcctgtacagcactcccaggtgactcaatcaacgatgccgacagcaactgtgacggagtgttgtgtagtggcctaggtaacatcatatggtcgatgttcctatccatggcaaatgggagcatcaagcaggatcctgattcgtcagagcttggagtcggggtcggcaaggctggtcgctggacagcttggtgagaaagtggttgcgaatgttggtcccagtgcacaaaccgctgataccaagacaaggacggtgcagtcgacggatcgtgatgcaagggcggagtgtctgattcttgttgagcaccattctgttgatgttccatcatgaacggcaccgagtgcgatgagctcagttgcgcaaacttttcttgaatatcatactccggctcgactttaggtttcttggcttgtgctctgcgagggaatgacttggcactgcatctgctgcttctcttggtgcctagtgaggatgatgactgggcactagatgagctggaatcgaaccgacgagccttgcagatcctcggcttgcgatccgcgttactgcctgcgagtgtcgagtctgttgatgttgcatgaaatgagttgatgtccggtggatcgcgagcagccatggactgcgtcgggtgcgaatcaaaaatggtcttcgagatccttttctgaacccgcttggtttgttgaggtgcttccgatttgcccacagtccgtttcgtttcgatcattgcctttgagatggaaatgctcaccaaagcgcagttgtccttgttcacccggcacaaagaccttggggacctttcaaaagtctcgctggatgacgtgcgcgccacctctggtagagttaagagatcgctcccgaggtcatcgtcgtcgcagtcgctgctttggtcggtttcagtatcgtccacatcggcatcggcatcggcgttcagatcgctctcacttgtatcgcgctcgcaatatcgtcttttcaatgttttgaccctttttgatggaggagagaagcgtgatggatcttgctcgatcgctggaggcagcgaaactgacgttcctgcagagccacgagaacctcgggcgtgagggttgaagcccttcttgagatcgttcaccttgctgttttggtagtgagtgacagcaataaacgtagtctgttggaaggtgtatgtagttgccgacacaaccgcgttagaatgagctgcacgctgcacaagatggacccgcgggcgatattgatggaacgagctcatatgaaagatgtgatgactgtttccgacggcactcttgatgcttgatgccctccgtgccgatttggcagcagactcacggctgttggacagcttggctttgtcgaaaaatatggtgcccttcatccaatgggcacccgcctgatacttgtctgggtgcgtgtacgactctttagcaagagccgcggccatctcccctgcatcgccgtcggtcctgatgatcgctttgctggccctccatcttccttcctcaaatttgaaccgtcgaccgtcaaccagctcaaagtccagatagatggagtaaatagcggcggggtccaaattaacagcattgaagcgtaggcaaggaaaaaggcatcgcccagacttggtgataatcatctcgttgccttgttcgttaaattttgaccatagatcggcatcgaccagtaaaagttcaggagccggaggctctgtgatcgagggcaagcttgcttggagagtgtttataggctgcgtagacgaaagaggcgccactccagagtcggtgctgtccttatgggaggcgatatcgtgccactggcagaaatctgtcgtgtcgcgaggtccagagctggtcccgggcacttggcgcagatgcaagtcagattcaggcgcatcgatgttctgtaaagcaggcgactgaggggtcttgttgaactggagtagagatgtccggggctcgtgagcatcaaatatggcactataccacagactatggtatcatggttgaatgaaacgagcaggccggcgacaataagtatggcggtaaacgcacgacaccaagcacagccttgtgatgatgaaagctaaggacgatactttacctggaaaacccaagatcaggacctggttcgccgatactctgctcagtgttgtcttgatggagaccaaagaggctgagagttgtatctgtctccctcctaccgcagtcttgcttggagggcgaggctgagtcttggcacggtatacgggtcgagatcgtgtaaccgcttgtggtgtcgtcttgccagtggtgaggcataagtactctcttcacgccgaaaatgcgatagcttgaggtcgttctggcggaaagatggcggaggtgagaaaagcatcggtaagcgcgagggacgagacacagggtaaagtacatagtccagatgtgatgctccacgtctgaaaacgatatcttccaccttttaaaaggcagaatcgtggcaaaacaatagtgaaataaaaaggaacggggagaacctatgcatatcaaagacttgctaatcatacctttcttacacttcaagtcgcgtcaaaaaaaaagcagcttcagagaatagatcaactgttcacaggatctattgcagagaaacagaaaacatgggcagagtgtcaacgcaagctgtctctggactcacaaaatcacactttttatccacctagcaaccgatcgcgctatgcccagaccaagaaaacgcagtgcggatgaggttcgggacctctgatcgactagacctcgactgttctaggcccacccccagacatttaagcatgcgcttttacccgccatcgaaaggttttagatatgaggatgtcgatatcgcatcagcaccaaaggcgactatgcgatgttgccgtgcctgtcaatatcgggcacagatctgagtggtgatcggccgggagaccgggtccaaggcgaaaatgactaggttatgaactcttgcgcaatccacctccccttctcgatacctccatagtggcccttctcccatcataccggtacagccagtccctcctgtgccctcgttgcctcagcccgctcctctcttctcccttcctcttgattcttccaactgagagaaaatatttgaaaatatgaaaaccaagataaacctgaggaaatgggtatggcttcaaaagcacgagagcagagacgcaagggtcatgatttcttatgaaaagatacagcaaataacgcgtccagagcaagaaggcaagcagggaaggaaaaggttgcgacggcgcagaaacgatgcgtgttgggtagttgtcgtgaaacgtgggtagcgagcacacaccgctgctggtgaagggctcgtgcaaaaggacaactctcgtgggcgaggcaggacgaagggcaagctttaccttttatgagacgcgccaactcctcggtctgttgttacgcgcaagtttgaactcgaggtcacaaagaacctttacaaggctgagacgaggaggaaggtgaccaagacgagaataaaaaagtgttttcaagatatgggaggttcggccactcttgcggcagggcagaggggcagaaagagcggacaaacaaaagacgacgatggatcgctgcggagaggcaggctgggaggggtgcagagagaaagaacaagaagggcaagaggaaagagcagaaacaaaaatacaaatcctcttgcgttttttgtcgtccgtcgttttgaggcagcttgctgatggtggcgttcgccattgtcgcagggggtgtccagggtgcagcctgaaagcgcatccttccactgctctcaccagactcgcagcgtgctggcgctcatgttgcaggtctggctatgcacctcggggcatcgtatgccgttccttctgctttcgatacaaagaaataaaaaaccgcacatcattcccatctagcacagcgcgcgccattcctgctttgatgaagcagccgccctagcccgtcatcagccctgcttgcacatcaaacatttgtcaccggtttgacctggagaaatacgcaccctgcaaggtcctcgaatcgacttgtgtcgaaacgcaatgcttgacagacaacgtggttgctttatttccccttcatcaaatgccctagacgcctcctctatatccatatcctgatcccgcaggtttgtcggacgctgccgtttttgatgccgcttctgatcctgcagcacgagggggtcctgttggtggtaacttgccgtgctcctctgtgcagtgaaatagcctcttgagggaatcgagacagatcgaagggtcctgctggttcttcatcacacatgcgtcgtagtcctggatgaaggggtcgcacttctccttcacatacttgataatcggaacactggcgaggtgaaaaaaaaagaagcgtcattgcagaggatgagcgagtgatccacatatatcatcagaccctcaaagacatgcttgctcccagttcatatttctttttcccagctgtgtccttctcccaactgctcaggtcatcggcattggcaaagccctgcctccatatacataaagcaaacgtacttgtcctcggagcacttggccagcgcacgcttctgagtaatgcacttgatgtcccagttctccggattctgagtcacgcacttttggtagagctccagctggagaccacaatgcttggtcacgagtgctacggtgttatctgctacgtccatgtggaagatggtcattcaatgtcgaatcggtttgatgagagcaaggccagattgagatcaggcgaaagttgtttatgtccgtgctgcgcgagcgcctataggtgactgtgatgatttctctgctaatctttcaccgtctgtgcaaaggggtcttcctatcctcaactctatgcgcgcgagcgcttggcctggataacaaacacattcggaacgccgatctccggctaagtagaaaagcgggagaacagactgacggtgagtaaaagcaatcttctatcacagggcgtcgtaccaattatacagtaaaaaccgcataccttttctgacaattccaagggtgtatcttcagaccgacgccgcctgcggccagttgggttcaagctgccctcggcctggactggtgcgctatcgccaacagcgagagcccgaacgtgcccctctctggtggagtcttccatcgaatctggtgaggcggcgtcttcagatctgtcctcagcactttccgtgtgatcggtactggataaggtggcaaccacaggctggcggccacacttgaagaagccgcatgcaacgccccacgcctctcggcaaatccagcagaaacgatgaccgcagagcatgcagtcgaccttattgcacccatcatctctgtgaatcagtatacagcagttcgggcaagggttggtgttggacaacttccattggatggtgctggcgtccacgtccttgcggtcttttcccttagcactgtttcctgtaacactaggcggctcctgataattggatttatgcgaacgtttccgccgagaaacagacggctcgacatctccaacgatcagcgagcgcatataagcaaagcaatccatgttctcgtggtgtgtagaaactccgcattgcaggcataattcttgttcgcatgtgtggctacaatgaagagttctttctggtcagtactcttgcctacctgtcgcagtaatgcacaacgtatatatacagatctgcagtccttaccaccaatcccaacggagccatcgcacatgaaggaactggagctccttccactgctcaggccgagtttctatactcgaaatatccttgctgagtcgtacaagcgccttcttcactgcggcctgttgtttggtcatggccctagtcatcactcggggtcgtgcgtggtgcgttattctcgattcagatgggacttcaaccatggacaccctggactggtcactcggcatttcccgtgcagatacggtgctattgtcgttccttgattcgtgtcttgaggcaagaaccatatctacgtcctctgcctgcgcacgagtagaatcggccatcggtgattttgcgctctcagggttcagatcaaacaagtcgagtagcgataccatcaaggtcttgtacagctccagaacgccatttgacgagaatgcagtcactctgcgagggaaaatagaaatgggaagtcgagtggtcgattccgttgtcaattgagggttggggttgggactggatccttgaacttgagaccccgaggaagtggttgcctgatgatgtggctgaccggttgcctgttgagagggtgcgggtggcgtgggtgctgctgaactgagagaagctcccatgcgcagggtcaggctggagaggtatgactgcgccatcgatgggaaacgcggatgcggtccatgtgtgacgccacaaagggcttgaaagtcattctcgaatcgctgaacaatctttcgagcagtcgcgtcgcgttccgagggttccggctcgatcttcgaacttttgactggtctgttagggctagccttcgtgggcaatgatacggcagcacaggaaggtttttccagcatcaaacctcccacttccatcagtgttttcaggtcctcgagaaatccttcgaaaaatggcagcaagtcctgcactggtaagccaatgacctttcgcttcacgtccgagacaactacctcctgttcgcatccgccacagaagcgtgaaaaggatctgtagggctggttgtattgattatactgagcataggtggcacggtccacatactaccacacacacaaaaacaaaacatagcatgagtgaataatgtggatcaagttcggagtgcaagcacagatattgcaacatgaggggccttcgttttaccttggtccattccgaaaggggaatggtgtcctgacaaacagggcacttgatttttgtaatgttgagtccccaagagttgctgacaacttctttaacatatctgcgagtcagttaaagtatcaaaggcaaatagatgaggatcagacgaggttagattcttgagggcgcagaaagagttgagagtacccagcgcctagccaacgcgtgtggatctggtcgtagacaagaaattcaagagcatttcggggctgcaccaatcagaatcaacgtagtcaaatgatatccttcagcttgagttacctctggaaacactctcgacagaactggtcccgacagaactcgaggcaaaagtctaacctggcatcaaagcagatggagcatcgctggagccagaactcgatatcgttgaaactaggctcgccctcagagccatcgtcactgcgccgatcctcgtcctcatcttcctcaaagtcgtggaacgagttgaagctgcgactttggttgtgatgggtttgcgtgtagtcaaagcgtgtgggatgggtctgttgttctgaatgggaggataatgcatgattttggtcctgtggatgttgagcgaaagattgactcggaggtcgaacgagggcaccactggagctgccagcgctatgatgcatgttcgcaggatgagacgacgacgatgagccggaagagctgccgagttgcgaggcactattaccaagcaacggtacgtgagagtgaccgtcacctgcaaggctgtggtgcctgtccggggatgaaggctgggggtacgtattggaggtggactcagagtccattctgcggtgggactggggatcgacggatgagccgagtccggtggttgccatcaaactaagcacttggaagatgctcagggggaggacaaggccaggagtgagggcgcagagcagtgggatggagtacgccacagcaaggctctgaaaggaccacgttctaaagtatccaaggtaccggtcaaggtcaaagggggtgcagcagcacaagacactctgtgactcgagtttaagcttgtgggcagcagctgatacggcggtgcgagagagtggtgtgacgacaaagagcctgagcggagagtggccaaggcttatgagaagagtctcggcaaagacgaatggtgggtttcttgctgctgcagcggagctcgtgcggccgtggtgcgaggccctcctcttgagcagagattcgctggctgactgagggcgagaatggggcactgcggtaggaatgcgcaggcgattgccagcgagggggcccgtggactttggttcagctggctcgtgctgggccaagggcgctgcggtcgagaagagcgacgcgggctgcgagtgaagggagcgaggagaatgagacgaatgaggcgaatggggtgcgcgaggagggtggggcgcgtgaggcgggcgcggtgaggagggggcggccaagagcacggcaggtggatttgtcgggtcgaggggagctggcaaggatggcgaggagagcgaagacggtgggaacaacgagggcgaggacgaggacgaggacgacagggaagaaagagctgcgagcgcaaccaccgtcgcagcagggttttgggcatcgaggtgcggcctgtgggactgcgaatcaggctcagtttcctgctcgtgctcatcccctggggcggatgcacggcgagacagcccaagcgccaggcgctcgtcgggcggcacagctgtggttgcagcaggcgagtccagaggagcagccggcgaagagtcctccgtacccgccaacaggtccttgcggacaggcgcagaaggaacaggggcgtcattgtgctgttgaggtgcctgctctctcgagttcattgactccatcatttgaggaggtgacaggagggcggcgagaactggatatagaacggagggcgacttgaaacgcaggcgtcgtgcaagtgcggagtgagcggagcagcgtggactctggtctgtggagcaggtgaagcaatggggtttgaacaagagtcgaattgattcctcaagttcatcgctttgttcatgccgaaagggtctgaaaaaaggagaccttgctctaattttccaccccctttcccccagcattgatcaccataggcccattcccgacccatgttatcttgcaccattggcaagtgcaaaccgaacctagaatgatcacgcgcgccacacttcccctgacgataaaaaggagcagggtacgagagcatcggtcccagtttcttttctttctttcttttttttttttttggagagtggattgtttattccaagtaaggtgaaacgaatgcccaaagaatgaagaacaaatcgaagggaatctattcacaggagcacagggatagagttagcatcggctttgacgatcgtcgaatgctctgtgcgcaaacacaactgcagcgttgaagacagggactgcgaggggatcaggaaaaataaaagttgtccacatatagattcggacaatgtagataagatttttcaagcatcatttcaggagttgactccagcttccttgctctgaacagttgattcaggaacagcggtacgaacacttacgatttacttcttcttggagacaccgacgacgcgaccgcgacgaccggtggtcttggtgtgctgaccacggacacggacgccccagtagtgacggagaccacgatgggcacggatcttcttaagacgctccaaatcctcacgcatctggttgtcaagaccgttggccaagagctgggtgtacttgccatcgacaaagttcttctgtctgttgaggaaccactggggaaccttgtactgggtagggttctgcatgatggtgacgaggcgctcgagctcttcgttggtaagctcaccggctctataatgatgaagaatgaagtgtgcgacataaaacgcaaaggtcaggccagtgttgcaagttgtatgatcgaggggttgggtcctcgtatcgaggctacacgccgaacaatcgaatatagccctatatactatgtaatgggatctgtcttccgggaagggtgatcctgcgaagaggccacactggtggaggtgatgctctgcattttcatctctgagagataatcgttcaactgctgctccttgcttgtcacaagtcatctggttcccgatatatcaaattctactgcttctcaggctgtcgtcaactgtttctgatgatttccatgaatgatcctgacgctctagtgcacactgctgccttgggatgaaacgcacctcttcttcaagtcgatatcagccttcttgcagaccaagttggcataacgacgaccgacacccttgatgttggtctagaggatagagcggaggcagaacagatagtggcaggtgtcagaactgacttttgctgtgcacaagaagaacgagtctattttgacaagaaccgaggtagatgttgggttggtcttaccatggcgaacatgatcttagtcttgccctccacgttcgtgttaagaacacgaaggatgtgctggaactggcctttctcaggaacaaggagagactgttggcgtgaacaaaacaggagggacagatagaatccagcattaatgagttgatcctttgactttcagacgtcgatttcactctctttgcgaccagcccctccatccatcgtgattctgtcatagtcggatgtaagtgaaaaattccgagcatgggttcccctcatgtatgatgcgtgctgatgtagcatatggaggcgatttgtcgaccgatggtgatccgtgtcgatcgatgcatggatggatggtttcgctggccgcagtacgattttcctccaaatgtgcttgccataatgaaagtgtaaagaggagtttgtcaaagagcagccacacgcaccatttatgagccgagtcatcgaggccccttaagtcttccatatcgtattaaaaagattcggctcctcaagaatgaacagccttttcgtcaattgaatctaaaatgtaatgaaggagcgcatcaccaggaaagggaacagcaacaggaaaaaacatggaatcaggatcatttggactcgatccatcacagatttgctgccgttactctgattcaccatccaagctcatctggattccacattcaacatcactcgtttttcgactttgctcaattcaccccctttgaccaccttgggatcatctcgtacctcaacacccctacgttgccacctcaacctaccagacttgatagtgctgtgcgttgttatactccgtggctgaccctctgcaaccgttattcatcgtgtcacttctacagggtttccttgagcagtcagaaacgtttggccgccgccgtcttgaagtgcggacagcgcaagatttggcttgaccctaacgaggtcaccgagatcgccaacgccaactctcgtaagtatccaatctgggtttctaccgacagcaggacaaagagaaactctggcttctggagatgatttcggaaatcaggacatcaaaaagacatcggttttccagcctgccttcgttcgactctctggcatccactacactcgagcctccccccccccttttttttacgcagttttttttccgcagcaacccttgtgcaagggtagacaatgattggatagtccaccacgggtgtttgggacgaaaagcatggacagaacctgcagtgtgtacgattggtgacagcagcttgcaagaccaaggagagcaaggcgtacagaagggacagggaacacggcccgtctgagcgcagtatctaacgcctctcatgttttgctatgtgcaggccagaacatccgcaagctcgtcaaggatggcctcatcatcaagaagccccagaccatgcactcgctcttccgccaccgcgagaagctcgccgccaagcgcgctggtcgtcactccggcactggtaagcgccagggtaccgctgaggcccgtatgccctcgggtgtcatctggatgcgccgccagcgtgtcctccgtcgtcttctccgcaagtaccgcgagaccggcaagatcgacaagcacatgtaccacaacttgtacatgaaggccaagggtaatgttttcaagaacaagcgtgtcctcatggagttcatccacaaggccaaggctgagaagcagcgtgccaagttgatcgctgaccaggctgaggctcaccgcaacaagaccaaggctgcccgtacccgccgcaacgagcgtgtcgccgagaagcgtgctgctttcaccggcgttgccgtcgctgctgaggagcccaagaaggccaagaagtaaattactcttcctgtctcttttagcccccaaacctcaacagaatacaatcaaaagcttgtcaaagtctctttttttcacatctcttttctcgtcaaacatacaataccgcatgtttcatgcgtgaatgcttctttttattcaattttcgtaaatgtagccgagtttgagcggaaaagaagttctcagcgacgtcgtgtttcgccaaatccagttgcagtacgtgtggggcgagaggacgatgcatacgaggatgtacccgaaggtcctgcataagagttggagtaatcgtgggcggacggttcgccccatccactaaaaaagtttgacgtcgaggcataagcacgctctcgcctcctgttctggttctgggtcgcaaggtacgttgctaggccaccaaggccaagaccagaccaaaatcctgggcgaaatccttctgcggatccatctaggtgtatgcgagtgtcatcagtgcacctgtgttagagtcaagtctccaacagcagcaaaaacttcaacagcgacgagggctgttcaatcacgtaccttgatacttgtaggagttgttattaccccatccacttccccatccgcctccatcgccacctccgcctccaccaccgccatggccaccggatccacctcctgaagctctgtacggtggcggggcatcaccgtcaactgggcgctggaggcatgctctcacgaacgaatacaaaatatatccgacgacaccgatccaaaccgaaaggaaaatggtgtctgtccaggagtgactcttggctgttgtgatgtagatccgaagaacaaaacagccaaggggagtggttaaaattcaagctctagttccaatgagaatgtagcaggactgcatagtgtgccgaaagggatgttacctctgtgaacccattgaggcgtaccccacggtgatctctggtcatagcgcatgtcggtatagtgcaggttgtattccagcccacagcttcccttgagaacgtaggggtcgtccgggtaatcgaatcctatgatcgatgcatagattttttttttttgtttttttgttttagaaggtttgtacttttgaacacttagacgatccaaggatagagccctggccttaccttcacagtaaacgtcaagttttccaaacttgaggttgtctggtaattcggcttgacatttccattgcacatcgcttccatcaaacccggcatttttgcattgtattacgtctagagcatggagtggcaggataggttaggggccatgcgcaaacaaaacgaaccttttcgtcccagtccagcgccaagacctaaggactatttaccaggctcaaagtctccacaggcgttgcctccgacacaggatgtctgcggcacagggctggtcctccgtcctgtggtcagcctgcccttgtgaaaggtcagcgtttgaacgtctcgaagccgaacttttttatgactgctgccaaacgcttggacaggagacgggtggaggagcaatgaggagagcgcaattgctgcgagtgcatacatcaggcgactgctgcttttgcggtgctgagatgctttccacttcatggtggttattaggtatagaagttgaagtgtaggtggtcaaggaacgagaatgagacaaggaaagagattgatcgagtccatgaaaggcacttcttggtcaatgcctcccggtcctcgagcgcgctcaaacgagccaaagtgactgtcattccaacgtggcaagtattctgtggctatgggtgccgctctggtcttggcggtcttctcgcttcgatcctcgcttcatagctcaatggcagaacttggtttttttatcatattttaagggtggttgcggtttccgccacaaggcggggtaaaaagttatgggctacagatcgtatcgttgatggtgtttacttggccatctccttctgttcctcctcttgggtctggcgctgcttgaggacgaggtccttgccagtgatgcgcttgtagagatccttgacatcgtcgcatacagtctcaaagtgagaggtggcgtcgtacgactttgagacaaagacctggtccttcgtgccatcgttgatgggctcgcagatgtcggcgatttgaataaacctatcaagtagtaaccatgatcagccaatgctctacagtgtataaaggtcatagactaacgcgcatccagacaaaagtaaagcaagtgcaatgtttggtgtatacatacttgtcgacaatgggtccaagaagggcaagaccaggcagaatctcctcttgagggttgctggtctcgacaatggtggatacgatggcgaggtagtggtccttatcgcagacgttgtgggaagaagagacaccagcaatgtagatgtcattcttgcggccgacctggttctggggaatgatcagctggaacgaatcgacattctccgtgttgggaatagggccacggagtaagcaaatggcgcggatgacacggtcgaccttctggaccttttcaggagcataggagggatcgcagatgacctgagtacacttggcagtctcattgccggagcggacaccaacaaccttgccgttctcataaacgatctcatcgaccttcttgtccagcatgtacgtgccaccgtagattgcactcaagctagcatgttcatgatcgactcattaatacgtgctttgactggtacagcgggaggaggacatccgtggacgcttaccgtgcgaatccttgaggaagctcacccaagccatagagggggtaaaggtatggggacttgccccagcgcgccatggaggacatgtataaggtgatgcgctcaaaggtttcgagagcagggcggctcaagtagctaaaaatatatgggattccagcacgagtattaaaagattgaaaagagcatcccacgcagagctgataaccttaaagcatgcctcgtacctgtcctccaaatgaagagccagagcgtgaccaatgaagtcaatggtaccaggctccaggccaaagtgcttgtagacctcctccatgggagtgacggccatgtccatgccctgatgggttgagctgtcatcctgcttgtaggtctggacaaactcaaagaacttcttggctctgcgcttctcaaagagccccatcagaggactgcggacggcctccatctctgtagctgggaccttggcgatcatcttgtcgcggaacacataagagccagcaacctgcttgaactcgaggtagcgggtgacgtctgtgtgggtcaggatcttgacgagctcgccgttgcccatcataaacttggggatcaggtcaacgctgtagtcgcggtctttgccaagagcagaggggggagcttcggcgccacggaactttttgaaaagctgagttggtgatattagcgatcgacggcaaggcagggtaaggcaaggaaaagagtatggagggatgggtcagtgatggttaaattagcacatgcacagagagcattttgtttctgagtgctgatattggcatctccggcagcaaagctcatcgtacactccttcgcactccgtgcagtccacgccagcatgcgtaacgttgcatgtccgtttctctatcccttttcctttcccatgccaactggataaaaaaaaggagtcgaggcgcgatttctgtccctgaaacgtccaacaggctcgcctgaagcgacgcgtggtcttacctgggtcaggttcaaactggcactctcgcctccgtagtaatcgttgcggtcgacgtggaggaccttcttgccctcaatcgagaggaggcccgagaggatgcactcggtcaagccagtgcccatgacaacgacgtcgtatgtctcatcctgcatagagtggggtgacaagcagaagcgacaggaggttagtaacgctggaccccagtcctacggggagagtagccgacactgtgtgtgctagcgtgtggtgatgtgcaagatggtggcattgtggctctgtgggaagatgaagaatggcgagagaagggtcacagcggcggacgggagggaggatgacgcgcgtgtggaggagggggagggaggaaggatggcgtgaactcttaccatgtttgctttgtgggtgtgggtggggtgttggctgggtggggtgtgagagagagagggacggctggctgcttgtgggtggaaggaggagtgggctggatggtgtgaagaaaagaacagaagagaaagaaaaaagaaagaaagaggatggggacatgctgaagggtgtgtaaaaagacatggggagcaagaaccggcagggctagcactcgtgtatttccacgcaatcatcggtaggaagtaactgcccattgttcctctccgccctttgcccttttttctccttttgctgcctcacctgtctcaaagcagaaaaaaaaaaatacattctggctcaaaccgcccctccttcaccgctctccgctttcccaccgctaaaagacacggaccatagcatctccaacagcccgatcagaagccaccgtcccctgccgcagcatcattcaccaggcaaccgacctccaagcgtggcaatccacgtccgtgagaacgcgattttccaagttgcagctacgcctgttcgcttccattccatacacttttacacttttcactgctcagctctacaccgatccagcaccatggcggacaatgacgacagcgacatcaagtactacattccgagagcacacctgccagcgaccatcatcgctctccggacatcagagaacgccacacaatcgcaaggggacgcactaatagaatacgagtactcggaggaggtcagagggtttgtcgccgaagacgaggtatcgatccaggccaggcgagccgacgtacgcgctacaagagacggcatcgttggcaagattcatgtcgccaagggcgatatagttgaccatgaaaggtacgcttgaccaactgactttttttgttctcgcgtgagaaccctcaagtgtgttttccacatgcaaatattgagcgtgaatatcattcttttcatgctttgctttttactcgaacgcgtccgatcgccgtcccttgcagtaaagccgtgttggattatcaggggtgcgatcatgactcggtgtatgagggcatgtgcgtcgtctgctgcaagtctgtcgaagttaccacacggtcgcatgttaacatgacgcacgacgcaatgtccctggctgtcagtcgcccggtaggatgctcgcatgtttactgcatgatggaattggatagaaacccttgcagactctcccacaagggtaaatgagcttacagagatgttccttggatgatcgtaggaagcaaaacgactggaacagggcaacgccgaccgactgatcgatgaaggcaaactctctttgattgtggatcttgaccaaactcttattcacgccactgttggaacggccatcgacgagtggattaatgcgcaaggagagatgcccaaggatatcaggatgttcccactgcccgacagtcctacgccgtactacatcaagctaaggtcagcgcggatctttgtgaactcgagtcactgctgtatcggctctcgcatgctattggccttgactgactcgaacgttgatcatactctctagacctcatctggaaacatttttgaaaaaggtcacgaagctgtatgaattgcacatctataccatgggaacaaggaactatgccgccgccgtcgccaatgtcatagaccccgatagcaagtttttcagccagcgcattctttcaagagacgaaaactcaagtatgatgttttcctgtttttgaggtacgaccacttgcgtgtgtgctccgggtatacgtctgctaactgtgatgtttacttcactctcaaggcatgacccaaaagtcaatcgagcgattattcccatgcgataactcgatggttgtcgtcattgacgacagagcagatgtctggcagtattcgcccaatctcgtaaaagtccacccctgtaggtttggcagcatcttggactacatgaccttgacggagccaggataccggtacttgtatgcatagggactgaacgattgtattttttctgtattctttttcagacgaatactttgtaggggcgggcgacatcaatgcaggtcatttgccgaaacaggaggcacacattgcgactgaggcggctgctgcttcaaaatcaactacacccaagtcagaagagaaggagacacagccggcaatcacactcgctacggatggctcggatacagcatccgctagcgatttaacccccaactccaaagagacatcagtaaaggacgccaccactgttccacctacagagccaggaaagatggagagtgataaggtcaagctcaagacagtcaaggcgaaagcgcctgtgctcgatgacgacgacaacgagctaaagcacatattggaggtgagagtcgtatttaagtcaggcttgcccttcgcctggatgaccgtgagacttaatacattttctgctggtcaaccacatctagattctggagactattcacgaaaagttttacgacgcaaaggaaaactttaagcagcatcagtccagaaaggatgctgatgtcaaggtaagtcacatacaatgcggatctcgttttaatgcataccgttcctgctaaataccttcttaactcggagcattgttcgatttttttttggctagtcgattattcatgacatgaaaagaaatgtccttcgaggtgtgaatattcttttcagtggtgttatacctcttggcgaggctcctgagctagcagatatctggagacaagcacaggcgttcggggcagaatgctcccgcgacctcaattccaggattacacacgtagtggcagccaaggtaggaagaagaggtcgttgtagttgctcatttcatatgctacgatgaaacgtcactgactccctcatacacgattacttcaataggctggaaccgacaaagtgaccaaagctcgtcagcgaaagaatgtcaaggttgttaggaccgaatggctctatcactctatcggaaagtggcaaagacaggatgaatcacagtatctgctacccgataagcccggtaaagcacccccgacctccactacacctcccccacagacagagggtgagggggaggataccggaattgaggatggagaggaccagggaagcgtttccgagggtatggatgaaaatcaccagccgatgagtatggacaaggatgagatcactgagcatttaaaaagtgtcgactgggatgatatggagaaggaggtcgaggatttcgttggtgatatggacgatactgacgccgacagtgatgcgaggttagctatctgctttttttttttaccttcccttcgcccgtttttgttattacggccgaggggcggatcagttttcagtcctgttgtctgccggacacattttcagcctacgaaaactaatcatcttgcgcttgtttatatgtgattaatggctcttagcaacacgcaaagcgatgccagcacggacggaaacagatcgccgctcctaggcttgaagcgcgctagagtacctcggcggtccggtctcggtaaatccgtgacatttgcaagcggccaggaagaagaaagcgactcggcgccaagcgatctggacatgggcgggttggacgagcgcgaggtcggtgatgagggtatgagctcggatgaaggtgacggcgatatcgacgaggaaagcggctcagatgatgacgatgatgaccgaccctccaaaaagctgaagcgtagacggacgcctgccaaaaacggacatgccacatacctggatggaggcgccgatgacgatgacgaggacgaggacgaggacgagggggatgtagatgcggatgatgaggtcacaatggagcacttgccgtcaagggcaaaggcctctggacgcgagcgagaagatgtggaagacgaaggggaggtcgaaggtgaggaggaggacgattttctgcgagagctcgaggcgcagctgaatgaggaatccgattgagggcgagcgtagcgtgggacgaggatgtccatagacctttctgtatcatacataacaacaacgtttcaggtcgtgtgggagaagagctcgacgagcgcgttacacatatgacgaagctgacacgctcgtgcatgggtcagcccctgtcttttgagagcgggaaggttgcctttcgcgccattctgaggaaagtcgctcacacgactggaccaacacaccttgccgtgcatatctctcgttcccagctgcatagcgcgctgttcaagatgaggaggcagctgcagatgcagaccagcgtcgcgggtgctgccgaggatatcatgatgcatggaatgcagtggttgctgttcttgttgttttttttgcataaatcaagcgaggaaggtgataggggccaacccacgcactgaacatcggcaatctatcgcagcttcccagcgtcgttcggctttaaaagtctcaccgcacctcattctgccgttgtttttcttctccaatctcttttgaccacacgctcattcagacacacacacacactcattcccttctgctccatctctcctcttctcgttgctcgtctcattcaactcgtttgatttcacacctccacactccactctcttcttgattgactcaccacccctttgctgcccgctcactgcagcgctatacccctcgtgttcccacaagtctaaatacaagtcatgccaccagctccaggttgtctcgacaccttcaggggtctctttgtctcctcaccatccaaccccaactcgcgctcgaccgccggcagcaacggctctagcccgtcgctccatggctcctcctccaccagtgcttcctcgtcaggcatccaggcgcctctagcgatcgtcgatatgggaagcaacggcatccgctttgggatcatcgcctcgctcgaccgccacctcccagtcctgtatgaagaacgcgcgtccatctcgctcttcgacgcccagttttcaaatgatgacgacctggatcaggaggaggagaccttcaaggccgtagccaagagcttgtctagagtgacgccatcgatctctaactctgcgacgatcgctgttatggcccgagaggaagccaacggtcatggcagccaagacgaggatgacgacggtctcagggacgatcagcattatgatgaggactcgagagccgcattgaggaaaaccttggttgccacggatgataacgaggccaccgttgcagttctcgctggacgtcctcgcacctccgagcgacagccgatcagcgaaaaggtcatggatgaggtcgtgagaacttttgtacgctggcaggcgctctgcaagcaggcccaggtccagaccgtgcgcgtcattgccacggaagccacgaggaccgcgcccaactcggaagagttccaggctaggatcaaggccgcgactggttggagtgtcgagctgctctccaaggctcaggaggccaacattggagccctgggggtcatggcgtcctatcacactgtccagggtctgtttatggatctaggcggaggctccgttcagctgaactatatcatccgtggtcctaaagacggtcaaggtcagagtagtcccaatgcacaatcatggccttacggagccgccgcgctgtcaaagcgcttgaatagttgcggtcaggaccaggccgcaagacaggtcatctacgaggagatggtccaggccttcaagcatggacttgaggacattaacatcgcaccagcagtgcgtgaccacaactcacgcgagggtggctacaggatgtatctctctggaggcggctttcgagcactcggttatctgctcatggcaagcaagatggagaagaaccacgacaagggccgatacccaatccctgtcatcaatgggttcatggcttctggagaggagctggccgaggtcgtgcaggcgtatcggttcatggcccctgaggatgtcaagacgtgcttcagggtctctaagagacgcgccaagctgattcctgcctgcgctaccctcatggcggcggtcatggaggttattcctatcaaggatgtgctgttttctgagggcggtgtgcggcagggtggctgctttgcaatgcttcctgtcgagatccagaataaggatccagcactggagaccgtcaggagattcgtgagtgcctttggaggtggccagcctcccctgagtgacactgacttggagtcactctcgtcctttgtcgcgtctgctctgccatcggattttgccaactgctgcttgatgccctcgtcgtcctcgaccggtcttgcagctccggctgccaatggcggtctctcgcctagcgatgcagctgagttgcagatatttatcgagagtctacctcgcttgatccctattctcgtcctggtcatgaactgctacaaccagatgccaaaggaggcccggtccacagcggcatggcagctcttccttcctggaggagcccttgccaactgctatggactgacccacagcgaccgcgccattctcgcaaccgtgctggcggagcgccacgagggtgacctggccgatcctgatgctggcgacgtcatcaagcacctggtcccaggcggcaagattgcgcgccaagctgtcaagtacttgggcaaaattctggccctggctggcctttgttcaccactcccaggcatggctacattattgcttggcggaccaggacttcacaagcatggtggtggacgcattgtgtttgagcaaacgccctctccctcggccaggaacggcaaccgtcgacagagagatcctgatcgaacgcgcgtcggtggcgatccttcgtcggacggtcagtctgatgtggaggaagacggtgtcgtggtactgcagtcgtcgcacctgctaggaggcgcggcctcgcatggtcaggttacggtccgtgtcgtgaagggtcatccactgctggaggcgcccaatgttcaggatgcggtcaaggcactctctcaggcggctgcaaaggcccatggctttgcaggatcgcacgacgagaaggtcccttccaagaagggcaaggaagccaaatgagtgtcctttcagtctgtgtccttgaataagaaaccctgtgtagcgcagcaagaaccatagtacatagcccccccaccaaaaaacataaccagtgatgaacataaagtagcctggttgaaggttcttgagagtgttattgcacacaggatggtccaatctatcgtctatgtctggacatcagcttgttatacacctcacccatcttgaggaccccgcctcgtccacccatgcgtcctgctgcgtcgtcatcgtcctcatcgtcgagacccgcctcgagtcgcatctgggccatctgggcaaggatgggctgccactcgttgaactttgcctctgcaagcaagaacccgtcgtgacggagggccttgccggtcttggtgctgtcctcgaatgccttcagcacccagtactcggctatagtggtcgtgcacaccaggagcagtcttggtcagatcatgggtctgcgaacaagtaacagcagaaaagcaaggagaacaaaaaaatacaaaaataaacacggctgctcaatgcacatcggagatacgtactggtgcgtccatagaactccttcagcgtctcgccgatggtgggcgtgctggcggtctcctcctccgtcatcgccagacgcgcagccagatccacgccgctcagctgcgacggcaccacctcgaccacggcctcggcagcagctgcaccgtcgccttcagcggtggcaggcgtgcacgtgccctcggccgcgggctctgctgcagcggaatccctggcagtggggtcactcgctccagcacttggggtcggctcagtcgctgcctggtccttctggtccttcttgtcctttttgtccttcttgtccttctccttcttctccttcttctctttcgtctctttcttttccttcttctcgcccttgtccttcttctcagccttgtccttgccctccttcttgctcttcttatccttctggctcgactcggctgcacccgcctcaccctcctcgccttccttctcaccctcatcttcatcctcatcctcctcatcgtcatcctcgtcatcctcctcgtcgtcgccctcttcatcgtcattctcgtcatcctcatcgtcctccccttcctcctcgtcgtccgactcctctcccaaccacagctgcgactcaaactcggactggcgcagacagatatactcggccatcttgtccagattcagcgagaaaaagtcgtccagcgtgtactcgcgatccctgacctcgaggatgcctccaaagataaagagcgtgctcttctggaccgccagcatggggttatagcgtggacaaggcatcaacggttcttcctcctcctcatcctcatcaccagcgtggttgttgctattgtcccgcgcattcctgccagatttcgaagccttcttggtcgacgcagactctgccgcgtcctcagcggtctgggcagctttgggcaagattccggcagccgccagggcagcagcagcaagagcttctttggtggacatcttttccgtggttgcatccttgcccgcgtcatcgccctcctgtggtgttgccacgcctgacaaatctccaccgtccttgggcgtccccggctgctcttcagtccccgcaaccgatccctcggcggctcctgtggtggcgtcatcaccctcgttctcgctgtcgtcaaaatcaccatagtcaaattcgtcatccgtgctctcctcccacttcattttttcccgctttccggacccttcctcatcagcaccatcctgtccctcggatcctgcgacccttcctgcttgcttgttgccctttctggactttttcttcttggcagtcttgggtctcttgaggttcatgggaaaccagcggccggtgtcgatctggtaggtatagagctcgttgtagaaagtactctcgagcgtttcctcattcacatcatcgtcaaagactcctccaaagagcaccgctcggtttttgtatggggccatggcgcatcctgaacgggccgagggggcggatccagatttcttcttcttttcccatcggatcaatttcggatccgtgttcatcttgagcagccaggtgtcggtgtggaccacgcccttgggccgttgaccctttgtgtactctttgcaatatccaccgtagaggatcacgccttcgttacaggggatgaacgagaatccagatcgagctgcggggcggatcatttgatcggggagctcgaccttgatccatttgtactcgagcgtgtcaaagacccaaagatcatcgtagtaccgtgtgtcgacataattgtcgtaaaaccctccaaacatcaccagaaagtttttccactgagtcattcgatgtcctgatcgcgctgttggctttggcttcacctccagcttctcccatgcattggtcttcatatccatggaccaaaaatcctggagcggtacgaaaaaaataacgatggtatgtaaatggcagtgtcaacaaacagggcctatccataagcgacacaggatttttgagggaaagaaaaggcgatgtccatgcaacctaagcgtaccttgtaatggaagaactgagtttcgttgggcgaggtaaactctcctccaaacaggaacaaggtgcctgcgggagtaatcgcgacctggtgcgaggatcgaggtcctggcgagttgggagaggtgatcctgcgccattcgtccttttcaatgttgtatcggtacaggtcgttgtagaacgtgctattttaaggagggaggggggggggggggtttgaaaaaacgtcgaggtgacagagttgatacgttgcttagtatcaacctgaacatgcgtttctcaggagggtaagaggggcgccatctgccaagctattatctgcccgtgaaattaccatttagcaccgtcatagaactcgcctccgaaaaagatgagctcgttctggttgagaggattggcagtcagggtggcattggcacgtcggctagatcgagacggatcgggatgggtggagagaagagcgtgagcgaaaaaaaaagtgatactcactcagcctcgtttctggtcacttaaggcgcacaagtagctgtcctgtgaagcgcatgtccatacctgggtggtccactccagacttcctcaacgatcttgaccttttcctcttgctatcatgaccgaaaagacccggggccgcagcgcaggaaaaagagcgttaggtgtccagttatctttctgcaggcaagtttcatatcagatcgggttcactgtcttgtttacctccttcttgaagttggcgagaatggtctcgatgtcctcttcctgctcctctacgttcttggctttggatttcttgtcctttttggattgcttgcgatcttgctatggagtgaaaaggtgaggacacaaaaggttcgttttaattccgccaggtcttgtcctgttttcggtcggtcgttcgcttcctttttctttggactatagtcgctcatcgttcgtttttaccttctcggccaccttggccttgtgctccttggtttttttcttcttctgtaaaacagttcatggcaaaacatgaaaaaaaaggattcgcaaaaggttgaaagggttagggatgaaagtcgttcctgtctgtgtcaaccaagagtattcctctctctctctctcacggcttttcctttttgttttcgtccctaatagcacttctcccgtacatccttcttggccatggctgcaggttgctaatctgccgagtgcgattccagggtgtggagtgtttcctgtgcgtaaggttcggctttagagagggagtggatgcccaaaacaacaaaaagtagcggtcacttttttcgggcaggtgtgcagttgaactcagccttacaacaacaaggcggacccatagagaaagaaaaaagaccaaagtggtccgggtcctcggccctatacgcttctttgtttctgttttcccctcccccttcagttcgggtgtctcacaacctcttgttactgccgtgtttgctgggccgtttcttttttcttgtttttttttttggctcgacgcgggtgttgtgtgggcgtgtgcgtagtcgatgctggtggtgggtgtgtgcgcatgtaagcgcgtggcacttgcgtagcgttctgctgttctttcttgacttttattggtttctttatctgttcatacaactatcgtacaaggccctttcttttttttttttttttatctctcgtttttttttttctctcgcgaacagacctttaaaaataacactgtccgttgttgttcgtgtctggactggccaggggggggggggggggggggtaaaaaaaaacatacacgacgaggatgatgagatgattatgatgatgttaagagagcgaggagagacgtctacgcctcgacaccgttactcacgcgctgctcgtggtacgtctcgagctggagtagccaatgttggctcggactcgtgggcatgcccaaagtcatgctctcatatccgtggccgccgatcggtcgcatcatcttttcgtcaagcagaccaccaccgctactactactactacgaccatctgccgtcgtcgtcgtcgtcgtgtccatcatcggatgctgaccctccggtggcgaatctggacccgaccaatcctgcgcgtcgtcctcctccccatcgtcctccaccatcgccacgtccacaaaatccacctcgtcaaagttggggaaactgacgtagtggctcctcgaacgggtaacgcccacgctctcggacggaacaccttgactggtcgtcgtgccataattcgagtactgactgcgttttgaggctgcgattgaaaagtcggccagactctccttggctgcggaataggcagaggacgaggatttgatcgtgccagtagagtggggtggggagctagcgctcagggctccgcctagagcgctttggatcccatcaaggatcgaattcgctcgactgctcgtgctgccagagctcgacttgggcagggcaaaggacgagaaggtgggcgagtgcggcggagactgagcagacacaagacacgttagcgtgtcgaggcaggtggcagttgtcagcaagcgcaacggtgggtgaacggaggtgtgatgaggatagggggcagcggcagagagcgagtgaccgtgcttgatggtggtggtgcctgaggaccctgtgatgggcgagggtgaggtcggtcgactgcttgacctgcttcgatggctggcagtgctgcttatgctgtgggtgatatgccttggcttgatgctgttgatgttggcgggggtcgatcggagctggttgggatatggctgatggttgctattgctgctatgcgggcgtggtgaggagggtcgggaagcgcccttgactagactgttgctggctgtgacgatatgcgctggcgaggatgaccttaaggttttgttgagccgagagggctggttggaagccatggtgtgaaatggaggcagaggccgcaggaagtgaaaaaaaaaagagctgggattcgaagggattgctgaggaaaaaaggtgtgaaatgtcactctgctgctggaacgaagggtagaagaatgcgaggatgcgagcgaaggtgtggggtaagagggggctggcgaagggtgggtggggacagaaggaggagactgtgggttgggatatggacgcggtccaaagaagaggagtcaggggaggtgaggtggtgaaaagtaagtggagaagagaagagaaggcaaaggcggacgaaggagacggaggagttatatatgaggaccacatcggcagtacgaggtactctagcgcattcaatcgtgcaaagacagtgcagacggcaggtcagtgcattctgaggtgtgcttcaggtaacaatacaaaacagatttgcatgtaataatgatgagacgctcctgcctgcgcgcactctatccctctctctctctgtctgtctctgtgtctcgtccgcccatcatgcctgtctgtctgtgggtggggacgttcggcaatgacttgtgtgcgcatctgtctggctcatgccgtgtttagttcggtgcttcaggccgtgtttggttcaatgcctctagtctgcctgcggatactctgcttggactgcctggtctgcttggcctgcttggtctgctgtcagacccctggccctcctccgatcttatgcgctgctaattttatatccatgctgaatggttgaataccagagtagtaagacgtacaggcacgctagaatagaaaaaagcgcgcaggtatggcacacaaaccaatagaaagacatagcgagctccgtcagcactagcggtttgcctgtgcgcaaaaggttgccagggtcctctgcaactgatgaatgcctttagaacaaaaaaaaaacgaatgccttaatcctcagcgagttgctgagtactttttctttttattggcttttgctgccccacccgattgcaaatcatgttttctgagtgaaagtgtgccaaggcgccctctgtttttttttgctgccgtgggcgatcacctggacacccgcctggccaaaccgactgaccgatggaattccacttctcagagcccggtcgtcgaagctgcagttcttcccaagcgcatctgtcagcacgacacaattgtcagcatcttttttgacgttgagccgcccagcttcatctatctgcaccatgctgcacaatggcgtggaaaaataaaatccgtagacaaccgggcagtaaaaaaaatcagagatggataggcccaatggctcttttgcccgtgccgagcgcttctagcccaacagacgagagcattcgatcccagacccttgacgaaaaaatcgagttatgtggatatatactctggacgcataccatcaacattgtaaaacctcagtgtccagcatcggaaatgaaaaacagacaaaaaacaagtgggcactgttcctgtctgcatatgcgtgtgatccccacattcttcgactcacacctgttctttttgcggtctgcccaaaacccccccacctccctccatgtcgtacgcccattgcccatcgggtgcaatccgaccatccgacgagattgaaaaattacaacaaacacataaaagacagaaaaagcaatagatccgtatcacgaagaagagaaatgaaatgtcctcatgcaggtacctccataaacagtacaatgacactgcccatcgctccggttccatccatttgttctactccccctagactcggcatccgcatcacctccagagccacctcatcatgggcgtcatcgtcataggagtacaagaaaatcgcgcgtgaaatgaaatttgagcgttgtggattagcattgaccgaagcacacgcctgcgctcgtcaatccattaataatgccgccagaccaaaaaaataaaataaaatagaaagtaacctaggcttgtgacgggaacaggttgactacatatcttggtagacataaggtacatatccggcatggtcgagctgcatggtttaggtcggcgggtgtttttctttgcttgaatgtacaaatgtgtacacggtacacgtcaactacagtacatcctttcccgcgactgatgatctattcatctgggtcgtttccgtaggtagatggacctatggcctgaaagacgaaactgtcgacccaagcgcaaaggggaggaggaggagggggtgcagcgaccctggaccattggcttaggtagacttttgttctcctttcgacacatttcttaccagattgtcttggaggaaggggaacaaaaagggaagacgacaaatgtctgcatgccatgccccttcgtggtcctcgtcctcgtcctcctagtttacctcccccccctttttttttctttcgctccactgtgtgtcttgcacgcggcatgcgcatgttgctgaacacgattttgtgctgatttgatttttccatggctgttgttgaacttgcacgcacccccgtcctttgggtcaatttgcccaccctattttttcgcatgttgcttcacattccttctcgcgtgcaagtacattttgagcaggttgctgtacacactagcatgagccatagaagcatagctcagatcttgtaagacgctaaagaatggaaccaccctgttttctattcctcccatgtggagaggagtagaagcgacgatacggaaaagtggtgcgtctcacacaccccctgccctggttcagggtacactgcgacgagctgtccgaccaatgggcggccggcgattctcaagaaaaggggctgcccccgacccagctttcccttttctgtcttttttttttttttgctgagcaaacgcccaacagtttccgatccagtgccacggtcacttagcagcaagcggtgttcttgagtctgtgccccgactcgctctcacacccctcacagacaccacagacacccactccactctaaaacacttcaggctctgcaagtgccagctggacacatagaaaatagtttcaaggagtacttattcacctcgtttgcatctgtgtagtgtaagcgatcttggagtctagctgctcagtctgttccaaactagggcgacggtaaaagagctgctgaaagggaacaccaatcatctcccagaatagctcttggtgtttgcatgcatgtcgaaatttttggatagcagactgaaggagggaaggaagccaggagagactggtagagtttgtcctcatgcagcggacatgttttttttatacatttttatttccctctgtcttcctacatacgtaatgtgttgaatgtttccatcgtcgcagggctggtcaagaaggctttcaacacccggatcaggccccctgtctaatgcaaaaaaaaaaaaaaaaaggaaaagggtgtgttgctgtcaggcaccttcttcaggcctgaagaaagggcgattggtcccttgtgcttgcgcgcttgacgtgcccatacccatttgctggagttgatcaagtttttttgttgttgtctttttcaaggagccgatccataacagaggaccttatgcgatgggagagagaacgtgaagggagggggctagggctatttacattccgttaatgcagccttgacagaagttctcctgatgggcatctgcattgtggcatgaatacgaacgcgatatctcaactaaggaacgactctgagtggtggtacgtcgcctagctttttttttagcgacgagaagcgccctgaagtcgttgtcctgcatgataagcgattatcctgctgtgatgaagaacgagtcatgcgaaacctctgttgtgaacaatcgaggcagggcggtgtgagtaacgcgttcaaggatggcatgaatcgcctggagtacggtatgcttcatcaaagcgcaggctagttgccccttccgacggcgagaatgcggcgttgcatgcacctatagtgatcaaactcaacgcatctcatcggacttttgcagcccaagtgaattcttaacactatggtcggagaatcagaaggtgtcgcgtcctcttgacggatcgtatttgacaacccgaacccgacgagacggagaaaaatattaaaaaaaaaaaactctcttgttcaacttgcgcaaccctatgccggatgatgcgatccagagcggtcaaactccaaaaaggtcagttcgaggcagaaaagacacagctgctctcctcttctggccataatgttcatcctacacttgttcttttttagcccggcgcgcctatgggaagccatcctctctacacgccgcacaggagcgagcgtccattatttcgaactcctaggttcgcattcaaagtgctagggcagctccgccctggtatggggaggatcaaagagttcactgtgtctacacattgtcatctacatggcagccaaaaagcacacaatgttcccaggaatcagcctctgcgtcgacgctaggtccatgtcattttcccaggaagcgtttccgagttcttggccagcctctcactggtggatccagcggccgttcagcacaccatcaggacgatcatggtgaaagcattgacagctatatatttttatttttgcaataaataggctagcgtcagtctgtggatatacgatatctgcttcacttcctctgcagtatcctaccaccctacatgtaccctatgctcatccttagaagcgcgcaccatttacattgaacccatcgcgtttctcactttgctcacgctctttttttttgagcgccacaaccatatatcactatgggagacacgcacgggtttcctacacccagccatgaagggaaggctgcggccctccacgagaaggaccatgccctgtccttctcagaatccttatccgaagacaacaccgatcttcacgatcaagaaaactcgcctatcgaggccgtccgtttgggtaagagcttccgtctccagcaaatgaagcgcccgcgtttttgatccaggccaaaggcgagtttccactaaaaatgcaaaaaacgacatgactctcgcatcacttttagcggtgcccatcacagacgatccatccctgccagtcgtcaccttccgcttctggctcatctccttcttcttcacagccctgggcgcgaccgttcagcagtactacttctttcgctcgtcctctggcacgtactccatctttttcgtcaacctggtctcgttctctctcggcaaggccatggccagaaccttctcagagcacaagtggacacttcttggccaaagcttcagcttgaacccaggtccgttcaacatcaaagagcacgccctcatcggcatcgcagtctccacaggcgcaggttcagcctacgcgatcgacatcctctctgcgaccgacctcttcctcggctaccggatcaacgccctcggatccatcctcttgatcatcacgacacaatgctgtggctacggcatggctggcctgctcagacggtacctggtctacccagccgagatggtctggtggagcaacctcgtccaggtggtcttttacaacaccatgcacaacacgcaagatttccaaagcatccgtctcgtccgtggctggtcgcggatgaagttcttctgggtcgtcacggtcgccgtctttctgtaccagttcatcccacagtggctggcccctatcctcgtctactttgactggctgtgctggatccggcccttcgacatgaacttttgggccttcttctcgtccatctcggggggtgggatcctgtccctgtcctttgactggacctccatcggcggcgctaccatgtacctccctctctcggcccaactctgttcgttcgcaggggtgatcgtcaattactggatcatcctccccatcgtgtggatgaacaactacatgggcgtcaaaaccatcggcaaacccctgaccaccaagctattctacgaagaaaccggcctgcccttcaacatcaagcccttcctgaacaaggactactccgtgaacgagaccctgtacgaacaaggcccgcccgccaacatggcacccatgtacgccctcggtttcatgaccagtttcatgggcctcgctgcctgctgcacccacgtcggcttctttcacggacgtgagatctggcgcaactggaaacaagccgtcggatccgaccaggaggacatccacactcgcatgatgcgcgtctacccggaggtgcctcaactctggtacgcagcgttctatatcgtcatggccgtgctggcggctgtcgcatgcgagttctacggcactcaactcccctggtggggtctcgtcttggccctggtggtcggctgggtcctcacgctccctatcggcgtcatgaacgcagtgacaggctatggcccgggcctgaatgtcatcacagagctcatctgcgggtacttgctccccggaaagcccatcgccaacatgaccttcaagtgctatggctacatggccatgtcccagtgcaacctcctgctctcggacctcaagctgggtcattacatgaaaatccctccacggtccatgtttgtcggccagatctggggcaccgtcgtcggctgctttttcaactacttgaccatgatcctgatcatcaactctcaacgagaggccctggacggcaccaagcctgatgccaatggcctatggactggacagcgcgttcagaccttctgggggtctggcctgatttacggcgccctcggacccgcgaggatgtttgcgctcgatgggaagtactggtttgtttactatgggttcctgatcggcttcctcggtcccatcgtcctctgggcgctgtccaaaaagtttcctcaataccgagggtggtccaagtggaatgtcgccatctttgcgggaggactgcacaacttcccgaacggttacgccatgggcatcctcgtcagtctgatcacggctttggtctttcaatggttcctgttccgataccacaaggcctggtggacaaggtacacgttcatcctctcggctgcgttggacaccggtgcggcgttcactggattggtcatctttttgttcctgggcggtggactgtcgccaaagctcgcggtcaacgttccgtcctggtggggtaactactacactccagagggtgataacggcccttacttggcggtcgatcgctgtggcgctgccaacaatgcctggacgagtggtgctgacctatagtcgctgttgtgcgaagtaataataaaaccggtgttagaccaaaaaccgcgttcaggtcgttgtattgcccatttcgctttaaagtcctctatccctacactccttccatccaaaaacccccccccccacgcagtaagcctcatgcagttcacgtctccagaattcgctttatagggtacgatggttggttgtcgagaaagctacgcgatcgacgctagcgagaggacggtgccgacgccagaggtgaccaagacaagggtgcaaggcacgtatcgaaagatctcttccatcaggctcctggggctgtcatgagactgagcaagcaggtatgccattgcaaacctcagtacaaaatatgacaagcccgaggtcgtcctgcgtgatagaattccacgacgagcatgccgaatctggggtcgatccatgctgatgatctggctgagtgcggtggggatcagaaacagcgtgccatagaagacaaagaagggccttaggaaccctgcccagtctgttgtcacggtccccaatcgcgtccacacggaaacatcctggtgccactattcagcaagtcaagaagccaaagacgttagaaaatgttggcaggataagatatgataagtctcacattgtagagagaataaacaacacaacgacgtgaggacatcttttgtccactcacactgtcatgctgacggatagctttccatagaaacactccgagttccaacaacagtgtcagccagacaaaaccagccgtcgttgaccctgcctacaacacacacaaaaaaaaaaaaaaagcacgagaaaccgttagcacagctgacgattatgcacacttactttaggagaaaccatatacttacatcgtgcagttttgtccagatattacggtcgcttctcgttaatccaagcacgcctccaagctgacataagcgtcgcttccattcaccaagggcaagctccaagtacccacactcaatgagatcgttctcatccgtgtcgccctcgtgtgaagaacgtggtcgtgcatttaatctcgaccgcttagtcccgtgaactgcagctgcctcgaatgcattgggcgaagacggggtcgagccatgatcctgggctcttcttaatgctgactgagggttcgccgaggtacgtcggctctgaccatgaccccctcgtattgttttctggagctcctgcgccagatccatggcctccagcagctcgtcctgcatatccgatatgcaatcgtgagggtcaaatccctgcgttcctatcgtgccacgacttgcggacaatggggtaaaaagaaaaacaagtaatctgtcaacgtcgatagtaccttttctaacttgcaccttcaaaaacacaagtgttctcacctcgcatcagagttgcgtctcaaagtcgaacgcgccatagggcgctctttgacagcgtgctgaggttgttcatcttggtgcctatgtgtcttttgttcaagaatcggctcttgatcgtcgtttccaacaagctcgcgcagagaattatcggacgttccgtagttggagatgtagttcctacgtgcgtggggtcggtgcggcaaataccaaaaaaaggtttaaaaaactgcacacccgtcctctttcactccatgtgaggactcttttttttttctccattcgcatgctcagaatgccttaccgaattcgctccaaaacgatctctttgctcccttcgccagacaaacccaaactcaatgcaagttctacgagttctcgggatggacgaagagttgggtcagtgggaaaggcataacctggagctgttgtggcagggtgactgtgattctgatcgtaagctgacctatgagttcagtcttccggcgcttcaggacaggtgtagagggtctggggatgggcggaagcatggcttttgtgtcgctggcgatggatgcgtggaagagagaacgtagagggtagaggaggttcaagtgcgttcgttcggctcaagacgagtagagaagaaagagacaaaaaaaaattggtttcacgtttgcttgacgaacagtttttattattgtcttgatgtctcgctctatgcccttcaggcctctattgtagtagcgccagaggatcctacttgggtccgttgatctccttgttgagcatctccatgaccatcgctccgcaaagctgtgagatagggttgtcctgtactgagacggccttggccactggattgccgaacctcgctccgcgctcaaagtcagcctgagcaccgtccttatcgcccttgagcttcttgatgatgcctcgctgcgtgtacgcctagtgtgagaagtaggtatcagaaacaaccacccagcggaaggcgttagtcatctaccggaagaacgcactacatgaccgagctctcttttcaaatgggacacggctcatacctgcttcaggatagccgtctgtccgctgccgtgctcgatggccttgtccagatcctgaagggctgctgctgtgttatcctggattcggtatgcctgtgctctgttgttgtatcctgaagcataggtcgggcagagctcaataacctcggtgaacgttgcaatcgcacctacaatgtcgtccttctcggccaacaagactccctcggcctccatggtcttggccttcttcagtaactcgggttcgatggctaagtcggtgacagcacagacggagagaacaagagggtgagaatgactgaccgagcaaagcaccattcaattcttagggtgcatgagcagagtggatttagctctctgagcaagggatatgtgtgtgtgtggggaaagagattgttgttgtcttaccgacaggctcggtgttgagcatggtctcggtctccttgtcaggcagcatggtgccctcgggattgaagaccatgtcgagaatcctggcgtcctttgcgctgacagatgtctttgttgccatgtctggagtgtttgtgggagggtggagcagaggtagagagagagaggctggctggctggctggctgtcgagaagtaggcgttgcgtgtggatgaagagtgtgtgcggtgtgcgcagcgtggtggacaggacgagcgttgctggtggttgtggagaagaagaaagaggaaaaatcgaacgaccgagggttgtgggaaagtgaagaggggaatcgacttcgaagtcacacctgagtgtagctgacagacacgctctgcaggcagagaaaggcatcgatcggccttggtgcagcagtgctgggcgttttgttcttttggccgttttcatgtcgcacgaatgcccatcgtcatggccgccaccaactggcaaggggcttgctcaagcagatccgtcctgccccactcgcggcccaatttggtctgggctctcagacgcacaaacggtctgcaacccgcacaacaacgcgaccctcaacataacgcgcgtgggcaactgaggaagatgtttgaagagacgattgtaacacacacagaggttctaattaggcgaagggtttattccatctttttttccaagatgctgtgcgtggtgtggtaaggtgcgtgtgttgtaaaaaaaaaaaaaaaaacaccttgatttctaacgacttttttttctttctcgtgtctactggggtcacagcagatagaatgccatggcagcagttcctaccagcgccgccaaggcttgcgaggaatgctttgaggcggatgcgccgctggcaggcgaggccggggctgcagcctctggggtgctgggtgaggaagggttgttgctcggaggcactggctgcgacgggttcgtaatcttgaacgtgttcgtgtaggactgctggggtgcagtccggatcacgatcgagtagtcgccagagggcactgtgctgggcaccgtcatgtccgcgcgtgtgttcgagcctgagcagtcaagtgttccgagcgtagccacgtaccggaccgcagtggagggcccgttcacaagatccaccttgaccgtcttggcgtccaggcccatcgaggcacagttgcctgtccagcccacaaagttgggcacgtccgtcttccactctgtgccgtccgttgggttgttgatttggagcatgtcggcactgacgacagccaacagagcagaggccgagatggcgagggcggcaagagacttcatagtggaggtgtgcgtgtgtgtgtgttgagagggtgttgcgaaacggtgggcagagagggtggatgtggaagggtatgtacagaggagctggtctcgaggcgacaagagagtcggaagtggtggtggatgctggtcaaagaggatgaggacgaaaaaagagaagagaaaaaaggcagaaaaaaagagcaaggcaaaccaaccgatggaggacgaccgtctttatagctcaacctggatgggccttcaagggtcgcagcatgcgtgcttcatctgcatggtcccaaaaggccgacgtgctcgtccttgtccccttgttgccttgtttcctgtgtccgcctctctatgctcatccttcttctccctcgcttttttctggcatccgctggttacttctgtcgtctttgatggccagtcgcgagagatattatatggtgcaacccctttgtttacgagaggccggctaaaaatatcgggccgacgcctccttgtcggtcatgtcgctgccttccaggattgtcgtcctacgcttgatgacaggccagatccgccttcctcccgtatgatttaatagaacagcgcccacaacatgggggggggggggggggtaggcaagagctgaaagattgagagtgagatccgagggaggtttggctggcagcaacgcatccagacgttgtgctattcaagctgagcagtagtgttgctcctgatgtacttgcgaacagatgaaccaaaggctcgacgtgaaagaaaaaagaggtgcttgccgcgtgaaaacaaagttcctatgaactcctctgtatcgcttctgcagcgtgcagtgaatcccatgcatccctttattcgttgccgtgtaactaactccttgagcacattttctggagaagcagaagaatgcttttatttttgttgctgatggcccttctcctggcagctcctttacacgttttcgcctccattggctctctttctctctctccgttgatttttctttcttcttgccgtgaacggattctccgttactctatcacggcaataagtcagtgtcctcagatgccatcaagtgggatcccgacaccgtgttctcatgacaggtcgcaaagaacctctttcaggacggtgcactatgtgttttttcattcagcgggaaagtgaatgcgacaggcgctctcttttgtgtgcccaccatgaccaagaagaaccttcggcaatgagcacatacggcttgcgatggttattagtcgagatggcattggatatgccttttccaaatattgcacgcattgactctacaggtacagaaaaaaaaaagggagagaggccgtgtaaaattctcggagagggactcttgcaaagcagggggaggttcaaactgcagcatcctaggagctgtcttgagtcatggtcttcctaggcgtctgtctgtgtgtgcaccctacaatgtcacactggtaggacgtggccagtgagagcgcgcttataatccagttggtggcgttcttttcaaaccgagaaaatctttcttttttttttttctactctgcttgcccaaatgggtgcttgccgttctctgccaagtgcgtgtgaggagagagggaggagtcgggtgtggatgggctcgcgaggatcccgtcgactggccagtgctgcagtccccctggcatgtcggcgtgctcgggagaggagcattagcactgcagcagcgcgggactcgggggatggagaaggcctcgcgagggaagatcgagtatctccagcggtgtatcgatgtgtgctctgatccagcagcacacaaggggtttagtacacgggcgtcgcacggcaaagtgcaaatccaccccttgcaccccatatttttcccacagttgcgctggatcgtcgtgctggctgcatacgcagtataaatatccccgtccagatctgtgctccacattcctctccactccatcacacaccccccatccacaccatgtcctccaacaccaccaacgcccgcagctcgtggaaggtctcggcctccatcatctccaagcgcacctccaaccccatccgcgccatcgtcgaccacatcaaggtcaagcccaatgccaacaagtccatgatctcgctcgccctcggcgaccccacgctctttggcaacttcaagatccaccagacctgcacggatgcggtcgccaagcagctccactcgtacaagagcaacggataccctccctccaccggctacctgcacgcccgccaggccgtcgccgacaagttcaccctggccgaggctcccatcaccgcccaggatgtcatcatcaccagtggatgctccggcgccctcgacatgtgcatcggcgtcctctgcaacgaaggcgacaacattctcttgccccgccccggcttctcgctctaccagaccttggctgactcgaagggtgtggaagtccgttactacgatctcttggtaagagcccttttcttttttgctgttttgttcgcttgtcaaaagatcatgggtcatttctctcatccaagtttcctaaataatcccttcaaaaaaaaaaaaaacttgtctcatgttcagcccgagaacaactgggagatggatctgaagcaactggagtcactgatcgacgagcgcacggccacggtggtgatgaacaacccctcgaacccttgcggctccgtcttcaggaagcagcatctcttggactttttggcagtgtgtgagcgcaaccacctgcccgtgatcgcggacgagatctactgcgacttggtcttttccggaaacgagttcttccccttggcctcgctcacgtccacggtcccggtcttggcggtcggtggtctggccaagaagtacctcgtccccggctggagagtcggctggatctttatccatgaccgcaacaacgtctttgaggccgaggtccgagagggtctgaacagtctctcccagctcatcttgggctccaactcgttggtccaggccgccctccaggatatcctccacaacaccgacccagccttttacgatgacacccgtgtccagctcgaggcaaatgccaagctcagcaccgacattctgtccaaggtgccgggtctcaaggtcattgtgccccagggtgccatgtacgtcatgatcgccatcaacgtcgcagagttcaaggacattgagaacgacattgtgttcactgaaaagttgttgggcgaagagtctgtcatgtgtctgcctggctccgtcttccagtgccccaactttatccgcatcgtcttcacctcccctcccgaggtccttcaggatgcttataaccgcatggccgagttctgtgctcgccatcacgtctagagaaaagaagaaggaagaaagaagaagaagggaaaacgataattgatagagaaaacatctccacacagcattttctattcttttccctttattcctttcatcatgtaaataaacaatgtctgatcataaaaacagcaaaatgcaaaaggctcgactatgggtttcagttctcctgacgtgtgtgtgcgcgtgtgtgtgtgtgtgaatgggtggatgtgcgagagtctccgtctgcgtgagagagcgacaatccaaatgccgtgtttctgcaggtccaaaagttccatctggtctacaattggtttattcaatcccacagggtcatcatcctggtccacatgttctccattttcattgtgtgatgtcctctttctcttcttcttaaccttttttctttttcttcttcttctatgccgagtatgcttgggtgttgttctgtaaaaatgtgagagatggaagattcgaatacaggcatcgtccaacagcgagacaccgttctgtccaacaagagcggtttttttctactgttcagttgaggcagcagcggcagaaccctccaacacctttgaatcctgctcctgctcctgatcctgatcctgatcctgatcctgttgatgatcatgacgagttgcgttctccgtctcagtactcaaaaccgttgcatcctgtggtccagatgactcttccacagattgatccgcttccttaaagtcgtctccttgtacagaacgatcctgattctctgtcaaagactctgcagcacccgaggaactctgagtttctccatccacagcagtaggagcatcgccttcagacgtggcccgggtctggggctgaggggacgcctcagctgtgctgttctctgtcgtggtggctgttgatttaggcttaatatccttcttgccgagaccaatgtcccagtccagcttcaaccgacggccttccaccgtaaatccattgtatttctccaatgcttcctcagcacacttgcggtcctcatattctacaaatgcaaacctgtggtacgataaaaatggtgtggatcaaattaacaacacggacgaataaaaaaaaacatgaagatcaaaagggatcgccacctcaagtcatccacgaaagagccttaccctttgttccgaccagtgtattgatccatgaccacagtaactttgacgatggttccaaacttcttgaacatgtcctcgacctcgggttccagaaaactatagggaatgttgccaacatacaacgtctttgaggccagacgatccgcctccgtaccgctgaagaaaaaaaaaaagaaaaaaaaaaaagagttcgagtgacgcaacatggttagagtcattctccaagtatgatgcaacgacttgaagaaagtcatcaaggaaaaggaggctcgatcttacaggttgactgtccttgactttctttgaggcgagcgggcacgaccaccataaccacggtcatatccacggtatccacggtatccacggtcgtagccgcgatcgtatccgccgcggtcatactcccgatcatagcctccccggctgctgtatcctcggtcgtatccacggtctgatcggtcatagccacggtcataaccacggtcatagcgactgctgtggtaacctgcatcccggtcatacccacgagagtctctgtatccgcggggcgacggcgtccggcggtggcgtggaggtggagagtatgagcgctcacggtaggagccacggtaagaagggggaggggtccggcggccgacgctgccacgcggaggctcgtgaggaggaccgcttgcataggccgggtggtggggggccatgcctggaggaggcgcgggatggtgggggacgtgaccaagggcatgtggcggctgggtcatgtccaacatggcaggatgctgctgttgtgcatagtgggccgagtacgcctctggcgggtattgggcatgcgggggctgctgagcagcggccatcatgtaggccgcatgggcattgtgctgagggggaggcacttgccaggctgctgcgttggctaggtgagcatgctgttggtgttgtgagtccatgggcgtcgacttgtctgtgcgtaagtctgtataacgcggctctatgctagtcgtgcgtgtgtgagtgttgtgtgaaagacgagggcgaaggtgagggtgagagtgagggtgggggtgaaggtgaaggtgggtttgttcgacaggaatgaagaggaaaaaaagaaacaaaaaaaaaaagagtctcgaagcgtgaaatgaaaacacaaaagacagtctagtcacatgggggatcgttcatttcactgcactcaacactcaacgctatcaaaagaggcactcagcgtgcgcggtgactctcaatctcgcgctggctgtcacgaagctcgctttcagagtctgcgaggtgagtctcgagcaagtccttttgctcacgaagtccctgcatgaccttgtccagctgcctcaaggcgtcgcgttgtcgctggatctcccgatcctggtccagcagctgtcgatctaggattgacgcatcgtcattgagcacctgctgctgcttgtatgccagcaaatcctggagctctcttttagccaccgtggagtcacctcgactggaccgtgtgcggagctcggcctcctcaatctgtcgcttgatgctctccagctcctgtttcaaccgttcctcctgcgcatgggtctctatagaagcaggccaaacagatgtcgattgatgcaaacagggatgtttagtactcataggcgacaagccgcgtggaagtcaagatcgagtacatcaacacatcaacgacaacggaatggcgtaccgtgagctgcttgatccttttgattcagacggctgagatagtcatcggccataacatgacccttctgactcgagaacgcagactttgtggcaaaagagagagggacggagggtcgtccaggttgctggcggatctcatgaactgcatagttgtcagacaaggcaaagttggagtcgcccaagaatgaagtcctgagcgatcctggaagggtggaagggacgcgctttccaagccgacgactattgaggatgtggaaaaacatgatgcactgatcctttccgatctgaggagctccgtgcacgttgaccagagaccatgccgcattgatgtcctccctaggaatctgaagtgcttgatataattcctcaaactgacccattcgaacttcacccgacgaaagttggacgttattctgatagatgctctcgtagttggtccggtctgagggggcgatataccagtcaaagtcatcggacaagttgttggaggatgcgaccgccgtgtcgagagcagagatggcattgtagttgctgggctggctctggctgtaggattggggtggggtcatgaaggcgcctgtgggctgtggttgctgcatgaactgttgattgtatccctggttgccgcctcctccgccgccgaagtagtgtacttttgatgctgggatcaagtgttgcggaagcgtggctgggatctctgcaatctcgccgttgatcgacgcatacacgaagcgaagcgctagacagaactcttcaaagtccatgttgccatccttgtcgatatcgcaaatatccctgtagtcaagggcaacatagcggattagaacggcctcggtcgacttttggcggcagaggggaggtcctccaagctaaccatctcgtcgctcagtgttcacgtaccaaatctgaccaagcatatccacatgcaatccagagttcatcaaaatctgtcgtgcttggacacctgaatcgcgatgaatgccaagaaagacaggaacgagtcagtgggtgtcgttgaagggcagttctccaagcatgactcgtggcagagcaagggcgcgtgtatgcatgcaagagggttctctcaccagtgatgtatcctcccgagggattcaggctggcgaaaatctcggcatacttttgccgctcagcctgtgacatgtccatggtggaggagcgggagtgggtggtatatgtgctgtgctatgctgtgcggtgcggtgcggtggaggtgcgtgtgaagatggagctggatgggacgagaggagagaaaggatggaagcgatggatgggcgaaggagcacagaaaaacgagcctgggagagcgagagcgagtgagcctgagcctctgtgccataaaaaaaaaaaaaggactgctgtagatcgagtgggcaaaatctgtggaggacaagcaggctgaaaagatggaagcaacgagtgcgcttgccagtctgcctggctccagtcccccctgccatgtccttgcgcttgtccttgcagccagccgtgcagccagctggggatccacacgacgattgcactggtgcactagtacactagtgcctggtccacggatccagagcagtctgagccccgcccggtcaggcacatccaagttcagtcactatgtctctaaatgtgatgtccccctgcaagcgctcttttctccccctcgacctcttgccactcccgcacaggaacacaccctcgactccccccaaggcacctggccatctggactgcaggaacgccgactcccctcctgccgacatgaccctcctcaccttcttcggatgcgccctgaccgcctatggccccagtctggccatcttcttcggatgcatcgcacccaacgcccagctggtcatcctcatggtctcgaggtaacctggatgcttctgcagcggacgaaaaccacggtgcatcatgggcgtacagtcaaacacgtctcccacctgacagcgtcccttcgtttctttctcttttccccgtccttgctatggatcagcgccttcttctggctactatctctgctcctcgcctcagcaatatggttcatagccaagagtagtcagcaaacctttacctccacgatcatctacacagtcctcctccaggagctctttcgatggctcctcttccatctcataaggtaaaaaaagacaacccactactgtccctccctattcaccatggcatttgccttgaagcaaccagtccaggaactaaacgctcgccagatattctctcttctcgccacgtccacacatccgacctccttcccactcttcagtcgcgcagagaaaggactcaacatggtggcccatcaccccacctccaagttcaatcgatccggatacgccttcgccgcaggactcggcttcggcctcatgttcggcatcatctccttcatcacccagctcgtccagtccctcggccctggcgtcctcatgtgtgcctcctgccccagcctatcgctttatttcatctccgcactgaccaccagtctcttgatcctccatcactgtgcatggatgatgatctccttcaccggattcaccctgcgctcgtacgcccgtatcctttgggtgatcctgtcgcattatggcgcctcctatctgaccttgctcaatgccagtaaaaccgtccctaatggatgcgcctactcgctcgcagcgaatgcggccctgctcatcgcctccgtgatcattgtcgtagcagacgtcaggaacttgcaccgcaagtcgtcgtaggtagcatgcagccaatcgaagcttttctctttcgctgtgtcattctctcttttttttgtcgtttcaaataaatcctgttgtagtctagtagctctctagggtcgtcgttttgtaggtttattggatctagtctaaatgctgtgagctagatgaacggcctccctgatgaagcgggtccgatcctgcatagctgaatcctctgacggtgcagcgtccactgatccgtccaactgcatgtcctgttctatactctttagtggtgtagtgagaagctaaggcgaaaagaacagagaaaaaaaaacggcaggtcagtatgttggattgaccacctgttttttttcagaaactgaaacagtgatacagcgatgctatttttttttttaccttgagttcttgcttgcgcacttgaccatattggtctcccacttctgacgccacgagaggcagaccttggtaatcaaacacgcccgtagtcctgaacagcactttgctcaaagtgtgcgtaaaggtagatcccagtcccaactgagcggcagccggcgtagagtccgccgctgtttccttgaacgagaagaagctagggcattgcaacttgtcggcaaagagcaattccgaccggctcaataactctgagagggagggcgagtccacgcccatggctgtactcatttcgctccgaacctggatatcggtgggctggccgagcatcatgatgttggtagagaccagcttgttgactgtcttggcgctttttatgcacagcaatccctcgtgattaagctcaaaaatgatacggatcggactgggagacgatcctgaagcgataacaccatcctgctgtctgaccgactcgtccagatatcctgcagagggtgtgtactccacctcgatcgacttgctcttgggccctactaaaggaagttttgatacggtcttgtaaaacggaaggctagggttggaagcaaaaggaacatactgtggtgagttcacttgatcacgagcgttgaatgccatgacgaagggaatctttgaccattctttttctttttcttttctttttttttacctgtcgaaaaagtacggtcgctctgcatctttgagccattcctgcaattccattgagtcaaacgatcccgagtacggtatgcgagccagcaaagaatccgtgtcccgaaagagcagttgaccgtaatgtgcctctaacgtgacaacctggctcggggatcgagctccgtcagcaaaactcgccagatgttgtgtcacactctcaaagtcctcaatgcttgatggggtggggtgaactgggagaaaggtatagatgcgctgctttggggtttcagctagctgagaggcagaagggatagcgttagatattagacactttctggatgcgtggtttgatatccaactgcagtatgagtatgagccttcgccttaccgcctttgtttgacagatgcgatggaaggactttctattctcgtctgcggacatggtgacagagtcaaatactgggaacaagcctaaagggctcagctcgtcgtcctggttgagtagtaatgacatttcgctttctaaaggctgtagacgatcaaaggctgggtgttagctctaagcatggactagtgcatcaaaggtggatctgtccctcgctcaacaaagaaacgaataccttttgaagtttcaagtcgaagagtcgttttgcctcctccatatccttgtccgatctaccagatatcaccaaggtgtgctcattgcttgccgagacaaacgtttctgacctcctcgcaatctcttccagttctgagggcttcgtcatgacacgactcctgttgatgtaggtcgagacgtcccaggcctcttccgttaccgcaactctttcctgaatccacgcctttgcgtcctgaatagactcctttgatccacggatcgtatacgtttcgtcctcgatattgatcgaaatgcggactcctttctccttttcgagttgtcttcgcgaggcaccatccgagccgagaatgaaaaagagctcccgcctgctagaaggaaactcttcggattcgctgtaggcgtctgccgctgagtaagggtcttcgaccacagggggtgcatttgaaactggagcaatcacctcaaggtccatgaggagcatgatctggttgacgagaaccgatttcttcccgtttgctggaatgctctgtgcgcgaagaacgcccttgagctggcctacgttgaacgaggatgctacggcgtccttgatcttgttgaactcgtcgggagagacctcgcggtttgctggtcgaagcgcgaggacatcgtccagagtgacttttgatttgacagaggaagaggtgttggtgtagaggtcgttgatgaggttcttggaaatgctgtcgatgatggtagagtcgagcgcctgttcggtctttgcagttctccgaacgggtttccttcttgcagctgctgagtgagcagcaggacatgtcctggaagtgcaaatggtctgaatcctgctcctgacaaagagacttcttgtgaggctgtcagcaccgatgccagctcttaatgcggcagcgagccgagtgttgtggaaagggatcctgctcatggccgccaaagaggttttgaatcaatgctgtgctgggcttgagtcaaaaagggaaaaagatctgttttctgcccttgcctcttcacccgctgctaaaaaaaatgccgtagcgcaaaaacaaagtcacacttttagagattttaccggtagtacagataccaagaggatcgacaaggatgaccggaggcagcagtaagcagcggggcatactgcgtggatgacaacgacagggcctcaagatcaggggctacaatggatcgtgtcgaaatcaaagaatcccgttcagcaacgcgtttcatagagaactgtctacagcttggatgggataagtactacaatgtaaaggtgtgaacgtgcaggatcaatacagccctgacacaacggggatgctctggatgtgaggtggctattttcaacgagtgcacgcctaattcctgaattagagtgtacctcagacacccagaaacacgcgcaccaccaacgatctgcccacgccaccatccgtcccttccttctctttgttgctcctctttccttctctcaccactcaagttcaaggagtgagttcagttcaccagtataatgcagagacgagcaggtggagtaaaccactcgaaaaaaaaatcgatgaaagggggacacaagaaaaggccgggatagtttgtctctaactcgccatacaagcttaaagaggagttggagtgagcaacactttgaaaaaaacacctcgttttttgtgaggagacgcgatgacagatcacttcacttcctcgtggacgcgctctgggtagccgggcgccttctctctgggtagcgcccgttggccaagagtctgcctttcagtctggggttgagcttgtacagagagtaataaagatcgccaccttgccaagctagaacgacttgagacagcgacttcagcgagcccatgcgtttggttggatccgggacaatttgaaacatgagcagcacttgaagcctgtgcggacgttattgttgacctttctctcccaacgtgttctagcgatagacgtgtgaatgatcaatggtgagagacatggatgacccttgctaccgtcttggcgagatttgagtgcgggtagaaccatggcttgaacagcaaccggttcaaaagaaaattttaaagcagcaatgtatctcttaaacgccttttttcataaaggcggctacaaatctgaagctcagcaatgcgagtgtgatccctttccatgccatccaaaaagactcttaccaaacgcgcgattctttgcatcgcggaggttggatatggatgtgattcaagagattgcggcacaaataatttctcagcaaacctcgaacaatctctggtcttctcagatgctacaggagtcgttttcgcacttgcattgcacgcataggggttcgacgtctacaggtaagccaaatggcaaagcgtggccgaaactgtaaagtgtcacccatgcatcctccaaaagtcattgttgaacggacgcgcttgcttccaaaagaagccctctaatcgcggtggtgaatgtatttaaggtttcagccgatccagggcatctcagtgctccgcttttcctccaagtcaccgcaagaagagcgcatagacgacatatccactatggtaatccgcgtccatcaactgcttcggcatgcgcaccatccggaacccctccttctccagccgctccagaaacgacaggtgcacataatcggtcctcaactcctgtgccagcaggaccacggtcttatccatccggcgcatcctcaaacctgcaccgccgcctctctgtgcatcctctgcatccgacagcaatgcctgaagcttgtcaaaacggtctccacatccatctttgagctgttgccggacacgttctcgcacctcacagagttgtttgagggtctggacgagttttggaacaatagactcgttgtacaccacatccgtcgcaacaatgaaatccatgccgaaaccccgtatcagatcctggtccagatcctggccccaaacaagttcctgcacctgaatatggcacggctttgttgctgtcaagttgttgctactgctgtgggaaccgttcgaatcctccaaagccttctttctcctagaccctgcagtactggtggatccagaccctgcactgttgcctgtctgcgccgaagccgccgccgccacagaaggagaggacgcgtcctgatcaaaatacttcttgtccaagttcttgcgcaggttcttgacgagcagaggcaggactggtttttgatccgtgagaagcaagtcctgacagagctctgccatcacaatcccaagcaacccacatccagaacccagttctaaaatactggtctctgcaggatcaaacaccaatcgctcctgtcctgtaccttcctcatcctcctcatcttcgtcctcatcatcgtcctcgtcgtcgtcttcagtgtccatgtcgtttgcagagaccccctcatcttcgctccccctattatctttacgatgctggtccgtgctgttatggcgatcgcctaccaaggttgtgtcattggccgttgccaggggtgggtgttgaatcgacacatcctccctgagagtcaacgcgccatcgtcggctacagccattctctccgcctgctcctccagtctccggatctgctcccgttgagccctcaacctactctgggcttctgactgctgctgatgcgacggtttccgggttttacgcgcttgatgacggtagcatgtcctggagagatccttgatcgacagcatgaacttggccatcagaatactcgagtcccaaacaaccgtgcccgtctgtcctggctgagagagtgtcgagagcgactgatggataaccactggttttttaggctgtggtgttgctatccggactgggctagcgggtccggatcctggtccaattcgactcgacttccgactgcccagtaaagctcgagtggccaagttcttgggcttggacgcgttgctgttgttactcatgctgctgccggtcaacccaggctccagtacgcctgttgccgctgttgctgaaaagggtgatctggaacctgtcggtgtggatggagacgctggcatgctaaacgagtcgaccttgcttaaactcgaccccggtctcgtttcggaggcttcaccctccatgagcagatcagtgccgtctgccgatgctacattcgtgctggggaagtacgatcctgctcgcgaatccggccgcgatcctggtcgactgacggccggcgagggcgcgggcgtgaagtcaagctcgacctcgaggcgcgatgcttgttgcgagacggatcggttgtgcgcccacggtgcatcggcggtttcggtcgtgaagagggaaaagacttcttcataagggtccttcacagcaacagagtcagggatggagaggaaaaactgtgctgccatgacgcgcagagtgtggatggcggatgtgtgtgtctctctgtgtgcgtgtgtgtgtttgtgtgtgagtgagaatgagtggcgagccagagatgtggagagtgaacgaacgtagaagaattgggtttgttggcttctaaatctatacatgtacagtactctataaattctaagcttcttgaacatagtttcctattcagcaggatgcgaacgagaaggagaggatggttagctatcaatacgggtcgggcctgctagcagcgaaagtgagccacacacatacctgggaaagcgccttgccggccattcagcctgcctgtccaccacccattcacgtccgcggtacggtccacgatctcgatacggtcatccttgcggaaactgagatccccttcctgctgagcatcgtagtcgtacagcgcaattgccgtcctcagtccaagacgcttggggacagggggaggtggccccttgtgagcggcctgcgcttgcaagctgttgactcccgtattaaaactgttgactgcgtgcgatgttgcggcagcggctgctgtggctgctatcgtcccagagatagagggcgccaggtgaacgtggacgttggatggtggtttgaatcgagagccaccccctgcgatcgcctgttgaggaggtgtcgaggcaccactctgcgccgcattgtaggccgggggtgggggacttgtttgagggtgcaagtttgtcgaggctgctcctgcctgccatgactttggtgtctcatgagccgcacctgtctgccatggttttgcgcctgccgaggctgcgcctgcttgccaaggctttgtacctgctgctgtattgcctgtctgccatggctttgctgctggcgcaggcggtgaatagcctcgaggttcattgggcatagccgccggtgctccatacgctccaagtgcagggtctgcatcgtgggagggtcgaccgtacttgctagtgtaagctagaggtgttaaatgcaaaagagtcattagctaccgtggaggatagcaagtggcccagtggtaagatcaggcatatcgacttactggccgtgactgatctcttggtgatgatttctacagactcgacagttggttcagtctgtggtttcctggcttcgtatccctggatgacatctctagagagatcgtagtatccgcttcctgctaaaggtcccatgcgatccagcatgacattgtagatgcgtagttgcaagtagaaaaatgactggaagatgggttcgatcaattgagttttgtagtaaaagaagcccggaagctcctcgcgcaaaagaccattgaggccctcgtagtcagaggtggcgacctccagctgcgactccaactgcaaatgatatgagaacagagcgaatgatgtcagtccaaatcgcgggtgaagtatatccgggcgtatttgagagcacaaatccacatcgatagaacgccaacgtaccttgtagatctgcttttcatcgctcaacgttcgttccttcttgtcctgcagtttcttgagagagatgcggaagcgatcataatcgagcaatttatggtcccgcttcgtgattgtcctacggatcagtttcatgttgttctgcagctcctgtagcggccggacaaccgtgagctcgagtttgtcctacaaacatgcaggtgatagccgtgcgcaagagatttccaaattgtgagcaaaaggggtggatggccgttgaaatttttacagactcggcgtcgatcactcgcacaatacgccgcattatcacccaccacttccggcagtagaatgtccctcatctctcgcatgactgcttgaaagtcatcgaccgcctgcaccgactctggggcggtctgcactcgccgcggcgtcacctctccgctaggcatggccagtgctggatcatatacttctgcgagaatgatgccaaactcggcttggtggttcagcatggctgtaatatcgatgaggcaagttgaccaaaaacgaaatgaagcttgcttagcctaacagatcttcgtaacatgtgacaagtgcaagaggtagtagtcatgtcggtttgatgtggatgccctcttaccagtgacgttatcgcggtatttgcagacatcattgagaaagttggcaataactttttcgcaggtcgtgaacttgttgttgagctctatgaattccagatcctttgtttctaagtggccacacgagacaagagtgaagttgtgcagttgcgtgagcgtgccgcatcatggacatgttgatagtggacgagggcaaagagctggtcggaacttaccatcgcgaatcccggtctttgtcgagagcgtgtgaggcagtcgagagacagccttcgtgaaccccttcctatcgagggcacaaaagcgtgaggggagaaaacagacataagctggagtcagacagtgttggacggcaagagcgggtgggaaggtgggggagatcggtttaaccgttgcgcagacaggtcgatctgatcgagcacttgccagctcatattcctgtatccgcggcgaagtggatgttggctgtgggcgagaatgaagaagcggtgtgtaggtcgcaaggaaagagagttgagggcagagaagagcgcgttgaatggagaagcaatggaactggcaatgacgaaagagagagagagagagtgagagaacaaaagaagcaaagaaaaaaaaggtgttgtctcggattcgaagcaaaaaaaaagcgtggcctgtgtatgtcacgttgtttgcaagtccctttgttctcgctctgcccttgaccctgctacggactcttgtcttttctcactcactcactcactcgtcacttcgtcacttctcgcgttcatctatcccactctctcaacgccctttcgtcttgtcagccacacgtcgcccctcttctgtatatacctggcctgctggtgcctcgatttcacattacacattgggccatcacacctcttgcccgtcaatgatgtccatcttgaacaacaaccccgccgctgtcgacgcctccgcgcctgaactgctcttggaccaacacgtcaagtacatccaggctctcgacactgtaatgccttctctactgctgctaacctgttctcaatcacattcgtcaccaggcacatcgtattcgctgcctcccaaccacctgctgctccaatctatcgtgtctctaacacctctttgccccatcccacttatagaagaaaaacgacctcgaatactggctgacggagcaccttcgcgtcaacggtctctactggggagccaccgctcttcaaatccttggccatcctgacgcgctggaccaggatcagatcgtagaatacctggtcaagtgccagcacgacaacggtatgtgcatcggcgagcattgcttgtgacgtaatgatgtcttcaagtcgattaacacgatgctaaacgtgtcccttgttgtaggtggatttggcggccatatcgatcatgaccctcacattctctcgaccttgagtgctgttcaggtcttgatcacatacgaccgtctggatgctatcaacgtggacaaggccgtcgactgtacgtacaagcgtcatgcttgctcttcttcaggaccaaccattgcttgtttgtcttttttcacccacggcaatcctctctctttttttggatgcattgactggctttacaaagactgacggcgactattcatggcctcattttagatgttatttctttgcagaacgaggacggttcgttcagcggcgattcttggggcgaggtcgacacacgcttcgtcttttgtgcagtgatgtgcctcaacctgcttaagcgattggacgataagcgattggacattcaaaagacgatcgaatacattgtgcgctgtagaaactttgacggcgggttcggaagctcgccagggggcgagagccatgcagctcaagtgtatgtttgcgttggaacactgacaatcctgggcgcgttgaaccacgtggatgcggatcagcttggctggtggctcagcgagaggcagctcaaaaatggaggtctgaatggtcggcccgagaaactggaggacgtgtgctattcatggtgggttctgagcagtctcagcatgctgaagcgatcgcactggatcgactcggaaaagttgacaaagttcattctggagtcacaggtaaagagagccgtcgcatttctcagccttggacatacctcctcatcaaaggaccgttgctggtgaacagaaatgctgccagagtcattgacatgttggatgatacctcgtttgtttgtataggataccgagacaggtggcattgcagatcgacctgggaatatgccagatgtgtttcacaccaattttggtatctgcggattgtccttgcttgggtacccgggattagtggcagtggatccagtgtactgcatgccgcgccatgtcatccagaggatcgggctcacggacaagcactgagaagaagggcggcaccattccaagcaccgagaaagggaccatgtatatagcagcgcgaataaagctggccgcagggctggcaggtagcaatgcagtgcacgcacgagcacctgcgtcatggcgcttggctccccggaagtcgaaagggcagaggaatatgcgtgtctctgtgcctgtccggcaaaaagtgcttcccgcgcagcctcacgcgtgcgagggaaaaaaatgacgcactgggggcttccagccagcagataaaaaagaacgaaaaagttaaaatttgcgaggtcaatcgttttttctctttcactctccaccttccaccgaaaagccctccacgcacacgcacacgcacaagcacacgcacacgcacaagcacacgcacacacctgcacgtctccactccccctttataccgacaaaacacgccatgacctcgacacccacaccggaccagatccctatcgaagaacagccagtgctcgaggctcttgtctccatcaagcaccgcctaacagccattaaaaaggaccgctcccgcttcataaaaacctctaccgtcacaggactccatgacgaactttccgtgcagctacagaagctcgaggaggtcaggagcgcgggcgcctcaaccatctggggctacaagaataacgtcaacagtatcctggacgaggtctttgtaatcctgtcgctgtgctttatggcagtgggcaagaccaaggaaagccccgcgacttatgtacaactgctgaccatcaaggtaaaagaaaggacacttgcaaaagaaaaccaagtccattgcctcagttgctattacgaccactttccatgtcgaggcaggaagcggcccttgtcatcgcacatccactgagacttaatgctgaccctcgtcctctcttgatgttgttttggtgtcatgtagcaatgtctgttgggattacaagagtctggagtatatgctgttggtaaacccacagtgctgtggccctctaatatgaaagaactagtttgcatgaattttttttttatgcctaactgtcttttcatatgatgcatgttctcggcacgtccaaatagaggacttgaagcagtacgaggacagactgcaggagctggaaaactttatcctcgtggatgaggcaaagtcttcgatacccgatatccagaccaggatccttcgccgcaaactggactttaacagtaatgttggctttgtgccttcttttccttttaacttgttgaccatgcgtaaacgcacgttgtcatagtatttggcactttgttaatcagtcaaagctcgttcctcgttgcttgaaaacgtgatagacaatttgatgaaggagttgcaggatgcggcaaattccatctcgccagaactcactcccgtccacaggagattggtccagctcaggattgaacttgcaacattggcatcgagacccacctggaatacctctgatatccatcacattcaggaagagcttcgtgagattgaggccaagcggtcggatggcaagtttctggatgggcacggcaacgttgtcagtggacaggcagcagtcattggactgttggaagactgctatgatgattgccacaatctgttggcaaccaaggaacgtgttcccaaggcactacaggacgttttccagcggctgcagtcgatcaagatggatttggagagactcgtcttgacccagcgctggacgctgagggagacggatctctggcagtatcagatgcaactgaacgagattagcacgttgagaaagaacggcaagtttgtcgatcgcgagggcaacgtggaagaaggacaggtaagccaacagggggcatcgcgttgaaaacgtgatctagcgggaactctttgcacgaggaccgactcctcactcgcgatcgcactgactgcttgaatactgataatgtttgctacactcatcatcgatgtacataggcactgttgaactttatgctgcacaagtgttaccgcctgatctacgtgttgctgtcagcgtccgagccgatcgcagaggcattgatgccgatccataatcagctattgacggttcgccgatgcttactcgaggtcaagaaatggggtggtgatttcacaggtaagaaccccgccctgctatcagtttacctgcctgaggtgccaacttgcgtcatctttgacactgaccccgttgtcatctcttgattacatttttctcggtctcgtcgtctacagttcgcgacctgtacccttatcaaatgaagctggcatcaatggacaacatgcgcgtggacggcaagttcttggacaaggacaaggaggtccccgagggtcagggcatttgcaattcattgcttagcgaatgctatgatatcctctatgagttgcaagagtcagtagtcgatgagggctcggagggcgatgacgatgaggacgaggaggagatcgagactgagcttcgtggatcaaaaaatctggatgtgatcgtttgagaatggctaccatagtttttttctttataagaaaatgaatttttgtacaaaagtctaacatgtttttatcttgatattatcctgcttttgcgctggccagtcctttttgtgtcagcttcagtaactgcccactcgttgttgtcatgctacaaggtggttaagatgagatgccagagaagagccgttaaaaaaggataacgccttttggaaaaaaaaaatgtccaaacatacatcacagttcacaatacgatataatacctctgaactcgcccgctaccgaccagatcatgaatatggaattcgtgcggcagaaaagagccccgcaatgacttggccgtcaccgcctatgcattgaacaagtagatacagatttcagatgtcagaactataccccacaccaagagtgaagagaagaatgacaagatgtataaggacttcttacggaggtcaacatgtctccaaacatctggcgcttgatcatcctcaagatctcgagccgtcccttcaaaaagtgcgtgacaaatagcccgccctgtcgaatcgcaaatcggtacgccacatcatccgagacgcgctcccgacgaccagaagcggccgtgatagtgttggcagtcgctgcaggcgtgtttcctgtcggtattgttgctgcggcggaagaagacgaggaggccgacgaggcttctgctttcacagccttggcgtgttcttgattggtcgctgcgatcagttggttcagagccgagtggtgacccgtcgtggtggcagagtgtcctccagatgacgtgcctccagatccgcgtccaggagcaggttggttcaaattgacgaggtgtgggttcgcgggtgcagaaagacttcggttcaagagcgaataccggatcaaggtcctgcaatatttttttgtgggcaggggcaaaaagtcaacaggagtgctctggcatccacatgaatgaaataatggaatagtctgcctaagggatcttacgtgatgtcttggtctgttgctccgatggttgcctgaatgttagagtgctggatcgaaatctccatgcacagtccactggtcaccagctgttgaaagcggtcgaagatctctcctcctgattcctgcgcagtgacacttcctgcagctgttgttattgtagttgtggtggtcgtggtggtcggggaggcgggtgatggaggaaggcctttggatgtcagtgcaattcgcttactgggtcgccctgtctttgcatcgctatttccggggccctcttccaacttgcgcttggatgccagtgcagttacagatgccttctgctgttcctgatcctgtagatcctgcagatactgttctttggcttgctggatctgcaagacatagtcgctagtcaacatcaccgcaaactcatctgagcctgttccgcccaagtaaaactttcggatcgttcctcgctggatcagctgtgcctgccgaaaaaagagaaaatgttggatgaaacgacgggttagacatgatccgaaaagtgtcctacaggtctattatgccatccaaagcttgatgcttctgaaggtggtcttacaagggtacgatccaccgtggtatggtccttgacgatgctgtagatctgatggatcatacacactcgcggaaagaccttgtgctgcttgacgcggctgggttgcagcaggttcaggagatagtggagagcagaaagagtgtcctttggaggatcgccggtcagagtcgtcggtgtcttggtgctaggggccggttgggtattcatgctagtctcaacagctgcggtgatttttttttataaagtctagtaatccaccgcgttcctttctgaggtagtcagcatgactctctcgcaggaggaatgagtggaatgtgcgtcaaatgagaatgctccgaggtgaacttgcttcgccctctcaaggtctccagccattatagaggatttctcgcagtcacacgattcgaaaatgaaagaaaacctgccgtcaaagcggacttgtaaccatgagatgggtagcagcgccttcatccaagggcagcgagcttgtcgtctcaatgcggtgtgccaacctctcgacaggacgattaacgaactctttaactatatcctcatatcctttgcgcgctaggatcgtacatagctgagaatcgaggattctctggagacattgtcaagaccaggggggttgagtcgaacgtgctgcagtggtagactgtaaagtcttgaacagtccctttgtagaacatgacgacggtacttgattacgggtggaggacatgagtgtgacgatgaagaaggagaaggaacgaaggaagagcctcttcacgtgatccgttggaaaccctgtgccataggggtaagctcatcgaccttgacacgattattgtcctctagaagaaagcacgtctttctccagttatacatgtgcatatcagttgagccgtacaaatcgcgttttttcgcgtgggtctgggacagactgcttgcaggttcatactttattaagtcgtcacaaaaaaaaattgtttatgtaacatgtacccgactggctcgccctcttcctctgcccactgctcaagtctccatctttgcttcgccccattctgcaattgcacactcctctcccacgacacacagcaacctgcatccacaccatgtccgcaccatcagagcacaacatctccccatccgaggacgacaagaacagcatcatcctcacagctgcagccaagggcgccggccttgcgctggtcgctggcggactggtcgccatgaccggtgcccgctactctcccacctacaagaccctcacccgtcccatgaaggccttcctgcttggctctggtaaacgtcctttgctctttaccgagctatcccccccttcatcctcgtcctcgtgctcctctcacctagcgtcaatgaaaacagcaggctgacccgcggtttccttcctttccatctcgtttttttctctcttttctctctaggcgtggctgcgacgtccatcctctttggtgatcacgcccgagttcagtacgaagatcgtctgctgctccgtcatctggatcaggaggccgcagacgctgcgcgcgccgagatccgtgctcagcgagggatcatggccgagctcaaccaccagatccgtgagaacagaaacatggtcgtcggagtctcctggctgacctgcatgggcggttcgttgctctacaccttctccaagaagggtctcaccaccacccagcgcatcgtcacggcacgtatgtatgcgcagggattcaccattcttaccatgatggcagtcgccgccttggagttgacagaggccccccagccaaagaaggagatcatcaccgatcagtggaaggctatcttggccaaggataaccagggcaactacatcgtcaaggacacaaccgccccagcgcgcaccaccacagactcttctgccgccgctgcttcgctctcttctgcatagagtaggaacccccctctaccggtcgatctacattttttcccttcaatacctcctgcattctctactcctcctccaacgcattttgtctcctcatcatctaggctttagccccctcagtagacaacactactccccatggtccaatatacaacagacatcaactttttttttcttttgacatagactatatatatatataacaactcgctcctgagggtgggtaacttaaagcttggaaccgttgtcgaggatttgggcacgacgagccttgatggccttgtccttctcacggatgtcgtcaccgcgcatgagctcaaatcgcgccaactgcatcatatggacctcatcaggaccatccgcaatgcggagcgtacgcgctccagcagcgaaacgcgccaaggggaaatcttgactcacaccagcggctccatgggcctggatcgcaagatcgatcgtgcgctggagcatctgaggaaccatgaccttggccatggcgatatcgcgcaacgcacctttggcattgagcttgtcaatcttgtccgctgctgccaggaccatcaaacgagccgcattgatctcaatacggatcctggccacatcagcagcgacggtgccatggcgcgccagaaccttgccaaacgtgcgacgcgaggggtctgtgacacgggcgatcatgcagtccagagagcgctctgccatgccaatagcgcgcatactaatgttgaaattttcgaaatccacaaaagcgttaacgtttttttgcaacggcacgcaccaatcgatcacaaagacctttctcagaatgaaaaaaagcgaccatgctgtaccaatgatgaatgcgaccgggtccaagacgtccctgaatgacctcgaatccgcgtccctcgcccgcaatgatgttggagacggggaccctgacgttggtgaacttgacctcgcagtgtccctcgggggcatcgtcgtatccaaagaccgtcatgggtctcacaacctcgacaccaggggtatctgcaggtacaatcacgatcgactgttgtctgtacttggactcgttcttggcgtcgctcttgcccatgaccaggtagactttgcagcgagggtcaccagcgcccgagatccaccacttgagtccgttaatgatgtagtggtcgccaacacgctcgatctgtgtctcaatgttggtggcatccgaggatgagactgccacctcggtcatggcgaaggccgaacggatctcgccgttcatgagcgggacgagccacttttgcttttgttcaggagtaccgtacttggcaaagacctccatgttgccggtatctggggcggagcagttcagtgcctatatgcaagtcgtgaggaaaccgtgaggtcgggtcagatcgactggcggaactaggaaaaaaaagcaaacatatatcgagaatcctttttccttgtttcgcgtttttacctcgggcgcaacgcgagggcagcgaccggtgatctcgcaaagagtcgcgtactcgaggttggtcaagccggggccctcggggtagctcttgggcaggaaaaggttccacagacccaaagactttgccttggctttgagctcggccatgattggggggacagtctagcagaggaaggtggggacaatatcaaaaagaaagagagtaagaatcatgaaccgtaggctgatagacgggttctaggaaaacaagatgatatagtaccttccagcgctggtcgccagtgccgacctggctctcgtagacctcctcggcggggaggcagtcgttctagacatgaggaagttggaaagtcagttgagaagaatgtgcgaatgcagcagaatggcaagcgcgtagaatggcggtgcacgggtcggtacctcgacaaagtcaatgagcttcttctgcagctccttgcagcgaggcgagacttcaaagatggatgacatggtgtggagcgagtgagaaagagaagaacgagggagtggatgggtatgaaatgcggacaacaggagttgcagcgaagacgagatgggtggaggtggaggcagagggagcggtggagaggcggggaacgaggagcggaggagagaaagaaggcggatgccgacccgtgtgctggtcctggtttaaagtgcaggcagggaactgctcgactggctgggtgcatggacggctctccggctgagggggatcgcttccctcgctctgtgcgctttcgatcgccttttgtgtgctccacacacttgaccgctggcgatccaatcgagcgcctttccgctgagtgtcaaaaaattatcgcccttatgctgttgttgcagctgctattgtactgtagccctccgctggcgccgatctgtccgtgctggtccccggtgtgctgagcgcggcctctagttttttttctgcctacggtagtcaacttgtcaactgacctgcttcggtttgatacctatagcctccagaatagactccatgatcggagaccgcccgaaccagaaagtatttcacaaactcacacctttcacactcacgcagcgcaacggagccactttcaatggaatgcatccataagatataatatatatacacagttgtattgcgaaggagtccgacttttttgttcgatcaagtgcagcagtccgctatgcaggttccaggcaacggtattcttgatatggccatcaacaaaagagtgtccaccgacccacacgtcctagtcattatggatgcgtaacctcggctcgcttgaggctccttttaaacgcacgcatgatgcccttcaggcttaatggaaccattgcagagaacgtccttacacatccagatcttcatctccatcggcgtcgcgtcctgtggaagaaagcctcattttcttgggcggccgctggtccaagctcttggtggattgacctgcaagtttttgttgtttcatcagcctccggttggcagacgatgaggatccaggagcggaagagcttgaggtggggcccatactggctgtcgaggaggacgttttcaggttcggccgcttgttcatggagagagaaggaggtcgcttcgactcgtcctgtgatgattccgggtctgcattttctttgatttgaagcgcctagttgaaaaaagttgatttgaacacgatcagtctcggtaccggtcttttctatcaactatccattgaccaaggagtgggagtctggagatatctgttaccttggtgaaagttgtggatgacattgaaaacagtcggtccgattccgagtacttgaccctgctcttgtcagactttgtgttgatgtatccgtcaaagcctcggatgatgttgccaccatgctgcgtgtcttcgagatatgagccctcgaatgcgtaaatgctgttctctagtccagcctgcagcagcaatttgaaggagaagggttggtatgtaggacggagggtcagtggcgagtctttccgttgcgtattggtctgttctgacatggtttgacatgaagcgttggttaccaagttgcggtcgacaagtttcttgcgggccatcagctcgttgagctcattcttggcgtcgttgtactgctggattgtcggcttctctttctaataggagtcatgcaaagagtgagttggtgaattatccttgaattgcctgtcctttccatacagaggctagttgcaaggatgctgcttacaggtacgtcgggcatgctgttagttcctattgtgtttctatcgaatgggcgtctctgtttgtgctcgtcaagtgaatgtgtgcggtgtgtgttcctgtgtgtgtgcctgtgcgctgttttgtcctgtccctgttcctgtgctgcgatggtggatgtggtgcttagatgtgaaagtcagcgcaatgggcagtcagcttttttggtggctacaaaaaaagtgcgcacagaagaagccagtcactgcaccactcagaccgcccaactacagttgtttcgtgttcgacttgctcctttcctcactgaccctgtgattgacctcagctgcctctctttttcctgtctcaactacatgaactccaccgccacttcctcctcacacaagcccatatctggcgtgaagaaactcgtccagcgaacaaagaaaatgcgcttcccccgtcgtgccaaccagttcctgcagatgcaggacgacaatggctactctgcaggccagttcatggcgcccaacccacagagtaatgcgaaaaataacgccctcatatgccgtcgcagaaggacacacacacacaccatatgcaccttgcgctttgctaatactcctcggctgttgacgtctttgtctcggacagttccatggaaatcgatcgtactcgctgtcattctctttatcgtcggtgccgtgggtctaaccatcggagcgttgctcaaagtcggcattatcgtcagtccagtaagtcgcacaccaacttcgtgtatcacacatcttaagcaaccgcttcaagtcagatactcacctcaacatgcacggcattctcgatggtgcattggcaacttgtaggattggctcgacaaaggaacgccgctgctagtccttggcgctctctgcttcatcccaggtaggtgttatccggcagcatcacttgtcaatcagcagggcgctaggcgatcacgctgttgaacgcatcataactcttcaacgtttaggagcataccatgtgggcctggcctactacgcttatcaggaatacgaaggctactcgttttctcacatccccgacatggacgactgatgcgctcagccagcccactctttattttgtacaatataaacatcatgtatttactggttctatgaaaagaacggcggcatcctcggcaggggtttactcatcgcaaagtccgttattacaggcgaatgtgattcttcaccctccatctctgacgctgctgtgcgagaaatgaatgtggtcaagtcattctcgtggaccctcaaatgattgaagcgtccatacgccgatggctccatctctgggtcatcctctagcgcctcgtcctcgtccgcgaacgccctcatgaaggatgttgccaccagaactgtcataaacacaaacgtcgccctgaaaatcttgcctgtggcagtgtctgactgctcatagctctgccgcctctgatagtcctcgctcgcttgctctctggcccgcctccgctcctctcgccgaatatcctgctcgtaatgcatttcctgatgggatttggagtcaaagtgtggcacacctcggccaaacgtgggtcggaaggcggcatgccccctggcagcagccgcagcggctgcggattgtggagagtggcggaagggtgttctccgaagcgttcctcgagtcggcccggatcgctgagaggaattactagagtacagcgtcccagtgcggtctagcagagtgaggtcatagtctcgtcgctgtcggtcgttgcccaggacagagtatgcttcgttaatggagaggaatgtttggcgggatgctgaagaggggttcttgtctggatgatgctctttggacaatttgtagaacgcagacttgatctctttcttcgttgcgtccttgttaagccctagttgctcgtagtgattgttgttgtgccgcgacccgcgcgaagctgtggtatggaatggagacgaggtgggcatgaaggatgtcgctgctgctgctgttgctactgcaggtcgaaggccgtggggacgcgagcactttgcagcgcggaccaagagccccatgtggggtcgacagtggtggtagtggagcatggttggggtgcttgctgcgtaggagatgcaaaacgagagcgatcagaaaccgcgagaacctctcgcccaaaaaagtgcctcaattcgcagtcccccctgcgcaacgtatttgagcgacgtggatcggacccctttctttcctttcttctttgcactcactcctcgacaccaccacctccaccccgccgcacattcacaatgaccgtcgctcatctcattcttgtcaagttcaagccctccgtctccgaggctcagggtcacgatatcctcagggccgtcgccgccctcaaggaccagctccctaccgtggtcgaatccgtccatctaggcgtcaacttctcggcccgctccaagggttttacccacggctttaccatgctcttcaaggacagggccgccctcgagacctatgacaagtctccagaacacgtcaaggtggtccaggagatcatccgtcccaacattgacgacatcctcgcctttgattatgacatcgaggactactctaacccccgcctgtaactgcatcgcttgaaggatataattataataaaaacagagccagttggacgatatctgccgcatttcttatctcaatttatccccagcgtttttttcttggtgcaagagtcgtatggagccatggagctcaagtgatggtacttttgggcacagaaggtggcgccgcgaggtacaccataaacaaaacatggcgcctacgactctttgatcaagaagcgaaaattcgataaggaatctttgtcttggtttctaaaaacagaggtacagtacatgggataagatggcccatgtcatcggggcgtttgtcagcaaacaggctgatgaataattgcttctcgtcacttcttcacaagagtcgtgctttggccgaaagggcggtaccacgctctattggcagattcacaaatccaatagtccagctcaaactaaaggcctcatcaactttcatatagacagagttctcgtggacgcgcagcacactgtcctacagtaggcgactccagactacgaagaaaagtcgcgagaggaaatagaccctggatgctgtttcttcgcgggcgtaaggccacgcgcctcgaggagtgaccgtgggaggttctcttgacgcccgtcagtgcacttgtgactgtgtgtttacaccaatttgtttttccgactaagctgtggcatgctctctttttttgcattcgcattcacttttgctgtacatcaccatgaccatggacgaaactctcggcgacgatctcgagaagaagctcagcctcaagggccagagtcaggaggagcatgttgcggacgccgagcctgccggcccagcagccaagaagaacaaaaagaagaagaagcctgcagcagctgcccccgcctccaatggcagcgaggaaaaatcaaccgaggaagccaatggagacgacgaggaagacgaggacgaggacgaggatggtgccaataacgcagagactaccagtacgtgtttgttctgcgtggacaactaaaccaagcggtcgtcgagtttttatttttattttgcatgtctccgcattaacgcttgaaccgcttgtttgcactacagctgtgaagaaaaagaagaaaaagagcaacaaaaagaagaagaaggttgctcagaccgagcctcctaccatccctgtgtcaaagatgttcgccaaccagatctatcccgagggagaaatgcaggattacaaggaggagtatgtcccaggacgctttgtggcaccgtccgatatttgcgctgtgctgaaataacccaagtattgatgacccacccctcgttttttctacctactaggaacctctggagaactacaaacgaggagaagcgttatctggagagacagatgaatgaccagtacaatgaggtccgcagagccgcagaagtgcatcgtcaggttcgctcttatgctcgccgcaacatcaagccaggcatgtccatgattgagatcgtcgagatgatcgagaacggcactcgcaacttggtggaagccaacgggttcgagtctggtatcggtttcccaacgggatgctccctcaaccactgtgctgctcattatacgcccaatgctggtgacaagaccgttctcaagtacgaggatgtctgcaagatcgatttcggcgttcatgtcaacggtaagttggtgttaagtatgattcacatgagatgtccatctgcagaggactgacaaaggcttttttgtggtctcttgtgcactgtccatgtccgttcacaggaagaattatcgactcggcgttcactcttaccttcgaccctgtctatgataatcttttggctggagtcaaggatgccaccaacactggtatcaaggaggccggtattgacgttcgactgtgtgatatcggtgcagccattcaggaggtcatggagtcgtatgaagttgagattcagggcaaaacatatcaaggtaaaaatggaattagtgtcagcaaacatcatgtcattgggcgcgacatagttgcgtttgacgctttactcatggtctcattgctattcttgtgctttcttagtcaagcctattcgcaacttgaacggtcattcgattgatccttacaagattcatggtggcaagtctgtgcctattgtgaagggaggcgatcagaccaagatggaagagggcgaatactttgctattgagacgtttggaagtactggacgtggatacgtacatgaggacatggagtgctctcactatgctcgtgtctatgatgttcagcatgttccccttcgacttccacgagccaagactctacttgcccggatcaacaaggagtttggcacgcttccgttctgcagacgctatcttgaccgggttggcgagaccaagtatgttctcgcattgaacaacttggtggatgctggtattgtggatgcatacccaccactggtcgacaccaagggctcctacacagcgcagtacgaacacaccctcgtgttgaaacctacgcgcaaggaggttctcagtcgtggtgacgattactaggggcgggatgacaatataaaatcaaatttttggctcatttgcattcttacactttttttgttctgttctgcaacgaccgcgttttcttcattcttctcttcatcaacacatcggaaaactctggcaacatcatggaggaggcaggcgcacaacagcaaggagcagcattcccagctccaccatattatttccagcggtacactctcgaaaacctgaatttactggagaaagctcgctctgatccggacaatccagaagtctcaaagcgccttgatgaactttcatttcccattattgcactggagccaccaccgccagtgaagaagggtgtctactggctatttggacgaccatggcctgtaaggattcgaaaagcagtgttagcgatcgctcttcccgacctctcattgcgcgccagcgctaatccgttgtactgttggctttcttgacttgaacaccaggttcaggacagtttagcgaccctggaagagcaaggaatcgaacagctttacccaaaaggatccatcggtaatacgacagctctgtcaaccggttaggagtattgtatgactatttactgcacgctctaacaaaactcttgaatgtatactagatcgtgtcaaggagctcaaaaaactcaaccactcagccgtcttcaactttttggagctcgtacataccctgtcaacctcccccagcgaggtaacatcagctttctagtcgaccggcgcattgtactgtcagagatagtcaagcgctcgtcgtaaccgagcgtcaggtgtccatggaactaactgcatttctgcttgttcggccacgacctcactacgatagtttgctacaaaagtcgaccagatccgagtgatttttatcaacatgcaccacatccttaacgagtaccgtccacaccaggcacgggagacgctacgactcatgatggaggatcaactgaacaggaagaagcaggagacgcttgcgatgagagagtatgcaggatttttgccggcttttcagcgtaacacggactttcgtagccaaaggacacgcacttgaaatatcagctacctgaccttactcttcctttcatttgacacaacaggacctgtgcgaacttaaggaagcagttggctgccttgaaagccttgaaacaggagcgccttccagtacctggtctggaagcggatgttgagatgactgccgccgtcgcatcaacacctgatgaaacgacattgacgtctccacacgagagcctagacgtcaagtcccgcaggaacagtggaaacgaagaccggagtcaactttattctagcaatgcggcttctgatcccgcaacaaagaagaatgctgaagcgatggctcggatgatgggtctatgcgacgacatacaataaaggccggcctttagacaactttcaactccaaggcacttgaggcttcatggaccagttttttgcctcttgagagtcagtccctgttatcgccacttgattctgaaccctgcgaacatgcagctgtcatgcaaccctgcgcggtcccttcatgggatcgatcactagcgccgtttctctttcggtataatggcaaatgagacacacaggtcttgtccttgtagacgtcaagcagggcgcacggttgtttagagctctgtaccgtataccgcacaggtgagaaaaaaaagggacgcgtccgttgggtacgacccgcatcgaccacattccacattctctgatgggagtgagtttgagacttgtgtgtgtgtcgctactctgtttgtttgtttcctctcggttcgattatcaatcaagttggcatcgcagctcacactggatcacggctcgttcatgtattgtgcgttgtgttctgctggaattacccgattttgatcttggctgaaagaaaaaaatagaaaaaaaaaaagtttttcacacatttgggtgcccatccatccctccctcccctcccccctagtatataaagccctagaggacaccctcggccattagcctccttttagtttttgcatatagctcagattctgtccgacgatcaggttctgtacagcacaagagtctttctctttgcgaactgcaaatccaaatccagatccaaatccaaatccaaatccaaatccacaccagccccaatctacattttttttccaccttcttccccccctagcacgatcactcctacgcgccttttccctgtaacacgcgcaaccctcaaccacatacacacactcactcacactcacactctatcaaaaaaaagcaccaaagcagcttcagcaaacctatgaagatcctcaccctctctgcagtcctctgcctcgtcgcgtcgacggcagtcgcggacaagaagcgcacaggcgtcgtcaacaccaatgttgagctcaacagcgaccgcgatcttcttcaagtcgaggcccgccatcacgaggtcagcggtatggaggctcgccgcaaccaacgcatgatcgtgaagagacatgatggccagcacaaggagcatggcgtcgaggcccacaaggatggcaagcgtggcagcgatgacgatgataagaacagggacgatgaagacgagtcggatgattccgaggacgaggacgatgacgaggacgagaaggagaagaagggcgacgaacacaagaaggacggcaatggcggagctaagaaggacggcggcaagggcaagggcagccccgccggtggcaagaaggacggaacgccagccggtggcaagaagggagctcctgccaagggtggcaaggacgctgccaataccgcgcctgccaagggtgttgatgccggcggtgacaagaagggaggtgccaccgatggcgacctcgctggaaccgtcaacgaccccaacatccccaaggacctcgcgagtccaatctggctggtggagccctacggagccagcatctgggagcaaggccgcgactatgtgatcagctggggtcccaatcccgaccctatcctggccaaggccctcaagcccaacacccctatcgatgtcagtttgatgcaaggcccacccgattcgctgcgtgacgtggctgtgctcactgccaacattgactctgcgctcaactcgttccagtggacggtcccgatgaccatccctcctgcgaacgactactcgatccgtctgtcgcacgaaggcctcttggatacgtactcgcactactttgagatctcggcgccgggtgatgcgcgatcgagccccagtaatgtgggacagcccttggagatgcctcagaagggtgatgtggtggtcacgaacccgcccttggacgacaagaccaagcctgccaatccccccaacccagtgcccgaggatatcaagcccgtcgtggagactccgcccaagaaggacgtgcctgtcgctgccaagccagtatcacacgtcgccaacggtgcctttggagagacccaccagaacgccaacatgttggcgtttgctctgaccctctttggcgcagtgtatcttttgtaaggaaggaaacgagggaaaagatcgagcgcgatgctttttgaacaaaagaaaaagaagaaagttcagatagatgaatctgcactttgtgaacaaaccccatcaccatctctcactatgtgaataaaagcgatcaggcagtcttgtcacacgatcatcgtttgggtggatgtttgcgcgcacagtctgcggattggcatcgaaaacagcgtcggtgaactaaaagtggtgaggaaaggtattttttttaatggaggttgttcctgaggaggagacagaatcgtgagagagagggagcatgtggtgtatagataatgggtggatgcgatggcaaaggaagtaacggtgttgaatcgcaaggaaggccggttgtgttcaagagagaagtgtgccttttcccgctgcccaacatgcagtccagtttgttcactttttcttgagaagcgatgtcaagataatggtaccaactgccgccactgtaccgacgatggccattccaatgtatccctctacgagcattagcaaagaaaaagaaatgtggacctcactgtgtcagtccttgtttcttggcgtcgtatccatattgtgtcatcctgaatgcatgtaggaaggtgcatgaaggcaagtatttttctacctttggcgacacgatcctcgatctgttggcggagagcatgtgcctgagagttgttgggttcgaattcgagcaaagactcgttgaacttgcgggcatcgttgtagttgccaagtctaaagtgtcctacagccagataaaacaggcactcgcgtctcctgtcgggcacttctctatagatctctacagaggatgatccagagtattagtattagtttacggcacacatggattccgagtgtgttcatgacggagagcaaaaaagcgagggaataggcaggatgaaaatggcggaaggagacgggtcttggcgagggttggaaaccaagggggccgtttatacctgtcaaaagcaacacgccctgagtctgctcgcgtctgttcttgctcttgatgagaccccaggcatagttaaaacgggtctgctctgtgacatactcgccctcgcgaatgtactgcttcttcaggacctgtgcagtttcaatgtcgacggttaggttagaatggaacgtcgacaaagaccatgcatgcccagcgctgaaagaggtgccaggtcctccagcagcgtctgcaaccagcagcctggtcaaagctgcattacctcgagctggctgtcggagaggcagatgtcggcgtcggccagcgtaggtagattgttgtcggtcatggttgcggtgaagtgtgcgcgtgcgtgcgtgtgttgtggatgcaaggttcaagagcaagaagcgggccataaagccctatggtttttttcctccttaagggtgctatccattacgacttccttttttattccctttttctgtttgttcggaatctccgaagtccattttttacccttcgccaccttcgcatcctcaccacagcagcaacctgtcttcgccttgcatcacacggatcaatcatgggcaactatccaaaggctttcgcgatcggattcggcattgtcgggctgggttacaccctcatgctcacaacagtgcccacagaggagcagctatacgaggcatgtagacgtcccgcggagcgcggaccggctgattgaggtcgcgcgcatggtgttgatcgcgtcgacaggattgttccgagacgctgagagttggtccggataagtctgcaaagccatgcagctaacccggatgcgattattcttctttttttattgtactcaatagaaactgtcgccagagctcaagaagcagtatgagcaggtcaaggccgaccaggcgcgcagacaggccttctctgatgtcttgaaacaggctgcagcagatcccgagcccatgtggatcaagaagaagacacctgctgcccccgcaccagcatcggcagcatcaacagcatccaaggatcaataagcaacgatggcccactggcaacaaaagcagtcgacaaaatgacgaagggcgattgtattattccttaacgcccttgctcgctgcctctatctcactctccgcttctggttccggactgccgactctgtcattgtccgctcattcactcggatttgttcgtcccacctgtattttagctcctccgtctcttgctctctcactctctatcgctctctgcctccattgttccctctcccgctcgcactctcacttcgtttgcatcctcgtatagaacgtccatcgcccgccattctatgtcatcaacaatgacccaaaaaaagtccagcgtcttattgcaggtggtgtgtgtgtggagttacagtcgacttgcctttgaaggcgcctgccgtgaacacatattaataaatgaaaaaacgacaaatgccgcgtgggcgaaattcagccttccctccgtatttcgaacaaacgaacaaaagtgaaatagacttgccacgacgagctttgccattcgcccatccttttctctctgttctgcattcatcttgcccgcacatctccctggctcttgcgttgcgcctccaacccttcgacttgccccaccccactttcctgactgacgatggcgtccttgccgggcatacccgcccagtataacaagaagagctcgggtatgtgcacatgcagccgtcgttccctctcaccagaatggagacatgacttctacaacacttgcacagcactgcagcatgcgacagtcaaccgctcttctcttcaaaccacctgagcacacttcttgctcttgattatggatgctttgaaatgcgctgccttgtgaggaggagggttatcgcagtacgcaatgcaagtgaccgtggcgtaaggaaactgatatgttcttgaaatcatgcttccctgtcattctagccgtcaagaggatcatgcaggaggcccgcgagctggttcgggagccctctacagacttttctgcgaacccgctcgaggtaagttgtgctgttatggtgctgtttgtaagaacgttgtatgcagctctcacagaactgataactggagcttctttttttcttctccacaatacgaagactgacattttcgaatggcactttacgattcgaggccctgaggagacagagtttgaaggtggactttaccacggcaggatcctgctccccaacaactacccatttgctccgccgagtcttatgttcttgacagtacgtgcgatagcgcccttttgtacgccgaacagcatcgcccttcacccatcgcctcgctcattttttttgtctcgtccaatttagcctaacggtcggtttgagttgcacaagaaggtctgtctgagcatcactggataccatcctgaatactggcaacctgcctggggcattcgaaccgttctcgtcgctgtcatgggatttctgcccacacagagcaaaggcgccattggaggactcgacacaagtgttacagcaaggaagactcttgccatcaagtgcgtatcgttgccacatccacactgtctagctgctggtgtgaccatggttttgaccagtctttctctttggtttcaaataggtcgaaaacgtggacgtgtccgacttgcaaactggagaacgtggtgatcttgcctgacgtggcgcctgaagatgcggtcaaagcgtctctgaaagcggacgagatgccaccggagttctcgtttggctatgagagcgataagaagaagaaagagaagcaggagagcactgcatccaatagtaacagcagcagcagcagcgatcacgccgtagtagagaagcgttcctccgaatcattagcggcttcaaaaatcgaacagaggttttctggaatcaacggcccagaagcagatacagcggcgacggcgacgactgccgttactacggaagcttcacctcaagatactccgagggagacgcatgtcatgtcgcctgcgcctcctacttcatccgagccgttgcggacgcccagtgcaccaccaataccgccatcatcaccacatcagtcccagacgcacacaatggcacagccgttgacacaggcgcggcaggccgcgaattccaacagccccatctggctggacgctctcatcttgggctttggtggccttttgcttgccatggtcgttcgtcgcttcctctaaaatgcctttcaccacttttcttttttgagtccaaactcgtctctcttacacacacagttttgcgaaggacagcatgatagaaaacgttttattgcagcgggcttcactggaaggcatcttgataaacagagcgttaccttgtcattttttttccaacatgcttcgttattcctttatttctttccttatttttttgggggggcatggtcgtctctccgttcctggtgattattgtccgggtgacatggaagggggatgaggggggtattgcatccttgaagatggtgctctttgttctttttttttttctttctttcatttggcactattcacattaggggagtaggaggaggaggaggaggaggaggggaggggaagtcacttatcggggtcctccaatcgtgaacgaagtcctatagttgggatgcagctttcggggaggggtgacgacggtgggcgagacgagagcagccttctcctgctcgtcctgctgttgtgcccttctcagcgcctgctcttcctcctccagggccttctcttggatagccaatgcctccaacgtctgaatctccttttgcagctcctccgccttttgttgctcctcagcagcagtcgtcgcctgaatgatcgcctctctcaattcttcttgctgttgttcatggcgttccagttctgcctcgatcgcagagggttccagtgtgtaggacgtcgtcgtcgccgtcgtcgtcgtctctgcttgctgctgttgctgctgctcctgtggttcctcgacaatggtcgtttgttcagccgtgactgtagtggccgtcatggtggttgtcgttggagggggaccaaagatgttgtggctggtcttcttgtaaggtctcgagaccgcgggtggaggtgtgtgcgcgggttgggagaagagggtcgaggtcaaggctgggtggcccttgggtttgacatagtcggctctccaaccggctccacgctcttcctcgggtgtctgtggccgtggctggtgctgctcttgtgagggtgggggggatgtccttgagggctgctgctgtacagaatcctgaggctgctccttgagatggttaaagagagtggaggtcagagctgggtggcccttcttcttcacggctgaaggatcagatgtactgctgttggtattggtggtgggttggctgttgttgcgaccgttgttgttgtggtgggtctcgtcgtcgtagatctggttcgggttggttttgggcagatggttgaacagagtggaggtcaaggctgggtgacccttcttggtgggcgagggggacttgtcgctcaggggcttttcacccgggctggtgggactgatgggaggcaaggatgactggttgctgtggtggttgttgcgggtttcgagaggcgcgtttttgagatggctaaagacggttgacgtcaaggcgggatgacccttcttgggagcctgtcctgcttgagcacctgccgactgaggaggcgagagtggaggagtcgcagaaaagatgttggagatcttgagcaggacagaagacaaagaatgagctagtggttagtcaagggtcatgtaaaaaaaagacgtgcaaataaaaaaaaaatcaagagtattccttacgccggtctgtggacgcgagccagcaatgctggaggtggcattgccaaagggattcaagcggaagcgcgacgggttcctgagggcgtcgacctgggtttctgcgacgatgggccacgagtgtctcgagccaatgagccggaccatctttagcacactggcgttatcccatatgtagcggacgctggcgatatggtcatcctggaatgaggcacagatcacctatcggagatggcccaaaaataaaggggggaacgttagcaacagttcgagatgaatcgacagccgtgtaactaggctgtcttgggatcataagggagggtcaaggtcctggtcctggtcctgacactttgtccggggaactggatagacgagaacacattacgcgcatactgtaggagatgaaaaaaataacaacgcccacacttcgccagcccctaccaaaccccattcgaaaacatcatgcaggctctctctggctctcatttttcgctgcagattgattacatgatgaggcgagaggtgctcatgtatcatacagcaaaacaacacaataaaacgcaaaaactcccaagcgaaacgagggagcgcgcgggagctgatatgaattcataattcatgctcctccaccttgccccatgcatccatgcagctaggctgcagcgaagatgcctctccgcccctcccatacccgaacccttgagtgttgtaataaaagaaattaaaaaaatacttcgccatcaagacgctgtcgcatgcatctccgcccaccccgcgtctttcacccgagcgtccagaaggcaaaaaaaaaaaaaaaaaaaatgggcggcaaaaatatttgcgaatcacacacctcccctccttccgtccctcaaaaatcgcgcgtggcacgcatgcatcgcgtgtgtgcgtgcctgtgagtctgcactgcgttttgctttttcgcattctgctttggctgttgcgttttcttttttttttttttttgtttttccttaccaagggaaacgtgatcgtcaggtcctcgaggtgatggggttcaatcccaggtaggagccagcctcccgctcccgaggcgaacttgactgtgacctcgacctcgtccacggccgaggactcgcccacggtgcggtggatggtcgtctcctcgacagccagtttctttgggtgcgagtagccaccggactgataaaagtcgcggatgagtttctcgccggctgcaccagcgccagtgggcaggaagacgatatggctgtcgggcaggtacaggtcgcccgcagaggggtctgcgcgaaaggcctcccacaggagtgactggggtgaggcggcggcagggggctgtgacatgagtggagagggaaagaataaagtttagacagatgagacaatggccaagggaaaggtactgaaggaaggaggaaaaaaaacgaggtgtgccaatggagtgtgaaggaatgtggcaaaagagtagaagagaaaaagagaaaaagagaatggacaaccacaaacgaacgactggaaaataaggacgagagtgagagagagcgagagtgagggcaggcagggtacaacaaagaaaacagagtcggggccttttcttttttaattgtgcgtgccgtgcaaccttttttttcttttcttttttcgccctttgtaatcgtgtggaaacgtgcgaaaccacagagcattggaagtgtctgcaaacagacaaaaaagaacgcctgctccaaccccttgctatgtctccagctttgatattgccagtctggcagctctgtctccataagcccatcatgcagctgcataccagactaaagtactacagacgtacaagtcctctcctggcttgttgaatgagggtcaacaaaaaaaaaatcacaccttacattttatgaaggctctcgcgtgtgagggagaacgcagttgtgtctccattacaatgtgatatgtctcaagtttctacgtcaaagtaatttgaatttacaccaaggtgtacggcgggcatcgggggcgaacgtcgagagtatggagagcgagcgtagctgagtgaaaggtacgcaatgagaaagtgttcccacatgcttgtagcctgcgcacgcattgatcttttgactctctctgtaatgaccgaggtgtgacagagcgtcttcacccgtcgagtcagtcctgagctggagcttgaaccacgtcaggttgacgaaggacgttgtcgtgcattggcaactgtatggcttttcagaatagaaacaaaggctgacctctgccactgctagtgtcagcggcttcattggggtcactcgcgttaaaggtagccaaggcaaaccttgcatgcccacgccaggttctatcaggcactccggggatatccacttgctgccggaagtgtacctttggccctaaacacagcagccgttccaggatcacctcgatgataaagcgagccttgcctctcatcggtcaatgcaatttatcgcaacggccttcagttgatccagcgtgcctctctatgcccttggttgctggcgatcccgaggtgatgattctccattgattcgatgcaaggatggccgtccgagatcctcatgagaaaacagtcaagtcaccccatccagagcctcgagaacaccacactgtatgcacttgctgctccaatcgcctcaaccattcgctcctggatggttcgtaccttcttgatgatagaagcgaaaagcggctgcgattcctgggcaacgcattgaagctgaaaatgttgtttattgtaatctgaggtggggggttctttgccttcttccgtgagacgcgcattcatcgtgttctaacgttcgatccagacggcttatgcgcgggaaggaggcgatacctagttggccatagcgtagtaaacagttgtcagtgccacggtaacccaatctgcgtgtcgtcgacggaaaaatgactgtaggcaaaccaaagcaagaaggcaaaacttacaagaataactccatcgccgcgaacaaacaacatctcgcagtttctcttgacgatctaggcgagcgatcagtgagaaatatcgcggtcagcgccgatttgtcaacatactccacaggttcatgatccaatatttctacagcatgtcgcgtccatggcaagctcgatccttgtcctgcgactcgtctcaatcagagagtgctgcgtttccttgcctgcgtccgttttggtgtacaatagccgtccctctttttacaatccacgagggtttcaaggtggcgcacttcaagcgatgagtataggcgcctcttggactttgatgatgttccattttcgcgcctgcatagtcctgctgctgaatcctgtatagatcccgcttttgaagttgtgctgcatcgcggcaaggctctctgctgctgaaggccatagctctttgcttaccctgataacctcctccatcgtctcgtcgttgacatccacaactgtgattgtctcctcaacgtcaccgagcaccatgttcaaatgaccgtcatatgcctagtttccacagttgccagaagggagaatgaacgggatcagctggttgcagccagaagtgttgcgcaagagagtgtgtcgttcgtctgtcaccgttgaaaacgaagctaccaagcgccgctcataggagggcaaaagtggcgtattacatgaagtttgccgctaagctcgcggtctccacgcagcttgacgtagatgcgctcgtctagtgaaaggcgaacgagatccagaggctcttcaatgcctgcgctctcaagtggtgcgtggtcgtccatgagggtgtgtatataggtgattggtaggagggtgaagtatgcgtgaatgagattggggtgggcgaatccagctttgtgtaagatttatgtggctttgccttggccttgaaggcgtggatacgcgaaatgttgctcgcgactattgttctgatcacccgtcctggcgctgggctctttgctaccaccgctgttgatgttgtggtcaatgctgctgttgagagtgccgctgctgtgagtgctgccgctgtgatgacttttgccgctggacgaaaggcctgttgctctccactcccacacgcggtagacgtcgccctgcagctcctgcatcccctcgcgcacactggggtgacttccaacagtcgtggcgactttcgcccagagtctctcctgatgacagggctctacatccgccaaaagagcatcacgaagatccatctcgaacacaaacaaatctgcgatcgactgaaatatgtctccttcgttctgacgcgcctgctcctgaagtctcgacaagactctgtcaaccatgctactgacaaataaggactctttacgtctccttgagatctcacgcgtggctagccaccctgccagtagtgtcgacacggtgcctattaccaagcataacaaagatgaaataacggagttgagtgccctgtacctcaaagctcaatgagcttattttcctcactttgcacatacctaatatgtgtggccaaaacgttgtgagccagcacacgatcgcatggcgaaggcgacatttcaagggtttactgggatttagagagcgcacgtaaagagcactatgatgattgtagagcaattgcagggggaaaaaaagaaagaagaaagaagaaagatgagtatggtgaattgaaatacggcgccttatcacaagaatcttgtttgttgtctcattacccgctgactctttcaaatacgagaccgtctgtcctggcataaagtttccttagcgcgagatcccaatactcatcaaagtcttttttggacacgctcgactgtcatagaaaacaggatggttagcacccttgcccgcatttcttggtgggaaaagcaacggatatggtgagcaaacgtacatgcttcatggactcgatgtccgacttgagttcctcaagaggcatccgatgacgcgcaaggagcgcaagagacatgggtggttgactatacagtttgcactcctgtaatccagccttgatatgtacaattttttcggctgcgtcggccacttgcaggctctggtactcgtccaaattatcgaggccacagaagggccttagaggaagaactccgccaaagctgagcacatggggtcgcaaggagtaatctggagggcataatggttccgaatgtgggctctgacatatggcatgagttggacatggaatgcaagttggataaagccatgacagagcttgctggtctataggttgaaaaaaggtgatcattgtgagaaggcttaatcacctttacctgcataggtagccacctcgccacctctgcaaacaacttacataaaacttttgtgtcggccttcttggagtgcatggtcgaaggcgtgcagaatccaatgtcgaggcgtgtttgccggtaccatagggcgtagagaaagaggagaatgaaaagcaatatccgtagaggtccgaggttgtagcgattgcgctctctgttagccctgtttgtcgtgggcggtgcgtactttggcacttggagaactttcggctgagataaggtcacgatccctattcgctgacttttggcgagtagcggcgaacttgggtacggcttcttttcgatttccaatagcgacgctgggtactttggtgtagacttgaactttttcaacacaaagggctgatttgacccactgaagtgagtgccgcgctcttgatcccagctgcgatcccgagactggtcgcgtgggctcctgtgcgagctcctgcttctggaggtgttgcgcgatgatccggaggatgcactctcacgcgactttgatcgcctcctccgtctgtcagactcgccgccactctggaatgggttttcgtccgaaaagttctctgctcgtgccctcttcttgtcttccaggttcgtctagtaagggaaagcgaaggcgttaagatcatgaacagatacagtgtcttcgggcatgtagagcgccaacaagcgcaaaaagcatgtaccttgctaccaatccttctgttgactgaagtgtgcgcttgttcctttccacgcggcgttgtttcgtccgttcgtcttgagtccttggtgctgtcgtgagtcctcggtgactttgtgctcgcagcttttcctgagggtctcatgttccgctcactctgcagaagacgaagaaaaaaaagaaacattgagcagtcaataccaacgactgggcatgggaactcgctgcatcattcctgccgcagcgtacctgtttcccgaccgccatggactgcgatgcctgtgacggttcagggttgctgctgtgttgacttttctccatagagcgtcgcttggacgccgcagaagcggtctttccggtgcttgtttgcgaggaagtaacctccgaagctgaatgaccgaacgcgagtgttgtcgtggacgagcgaggcactttaatgatgcccttttccgatggcacgacggtctcatagtatttcctgagcgctgacgcctgtggtcgaatgtgcagctcaaagaggtcgatcagctcttgctttttcacagctccagtgggagccctgatgttgtgactgatgaggatctcgcgaatggtgtccatcttgatcttcaaggggtcaaagtccggctggaggtagcgcggcaccttgatgggcggcattctgagcctctggtggaaggtggatgtggtccgcgtgcgatgtgaaggggacagagcagcgaaggataagcctgacagaagaggcgcgccaaaccgaaatactagtgcacaaagaacgcgaacaggtcaaatttcaaacccacgaaaaaaggtcacataagcattcgcctgctggagaccttcttcattcacaccatcaacacaccacacagccaggcctgacggacccacctaatgtcaacatatgcacctcggcgagagttcacgccgcgcgatggcgctgctggaggctacggctcgcggatagtcttcggtagggcgcactagcaaccaatgtcgaatggagtggcagatggacgtccacccgtgtttgatccaatccactgccgaagtactcacatgctgatctcgaatccgcacggcggcacaaccgctctttgctagatggaaaacgtatgcgcaagtcaatccaacggagaactgtcgactacaaccacagcattaccaggtggctccaggtgaagcatacattcaatagcaaaagtcgcttgtgatcaaccttttgagcctttactgtcgaccacccactcacccctgaactgccgtgcatactagacctcgccatacatcgtgagcaaaagagatctccccttcctgaggccagaccccaattttattgtcgacgtaagtcctgctttttcgttttccagcggcggcggttgtgatgaccatagacgggctgctgacgctattgttttgtctttagctcctaccgccttctgcctacgcaaacaatcctacgaacgctgtcaccaccaagtttgtacatacatccacgaacaagaaccggtgtccagtcaatgttattcgtgtaagaaatcacggccatggatcgactgataatgcctggggaatcatggacaaatgctgatacccttctttaaatcctttttgcaaacagtggactccagaaggaaggcgactggtcacaggctcgtccagtggtgaatttactctctggaacggcttgaccttcaactttgaaactattttgcaggtaaaggacggatgctcaagaatactggacgcctactgccggctggatttctgacatcgcacatatgttttactttgattaggcgcacgacactgctgtacgagccatgaaatggagccataatgacgagtggatggtcactgctgaccacaatggattcatcaagtactggcagtcgaacatgaatccccttaaagtttttcagggtcacaaggaggctatccgggatctgaggtacgtgggttcatgacaccagggtggtgggaggctgtacggcgtactgtatactttgacctaacggatgtacaatctgtgttacgcaaccgtcaatagcttttcacctagtgatgctcggtttgcgacctgttcagacgacggaactatcaaaatctggaactttaacgagggcatcgaggaaaggacattgacaggttggtgtttgcacggatctgtctgtatagatattcaaaaggagatctttccatcctttcaagtcatcagtatctgacaacgctgcgttcaaaaactcctctacacatagggcacggatgggacgtcaaatgcgttgactggcaccctcaaaagtcgctgctggcatccggaagtaaagacaatctcgtcaagttgtgggacccaaaaacaggacggacattgacgacactgtaagtgttttttagctaatcgtccactggtcaacgatgttatgttggaagcactaccagtatatctgatttactctatcgacttctgaaaccaggcacggccacaaaaacaccattcttggattgcagtggaacaagaatggcaactggcttgcaacagcagcccgcgaccagctagtcaaaatctatgatatacgcatgatgaaggacctgcagacgtttcgtgggcacaagaaggaggtctgctccgtcgcatggcatccccagcacgaatcactcttggccacaggaggctcagaaggctcgatcatgttctggacaatggggcagtcagaacccactggaggcatggagaatgctcacgactcgaatgtatggtctctggactggcatcctgtcggtcacatcttggtgtcgggatccaacgatcacacaacacgcttttggaccaggaaccgaccaggagagtctatgcaggacaagttcaatgtgggcatccagaaagctgcagagatgggactgacggacagtggggcagcacaggacgatgacaatgagtttgtgcctggacttggaaactacaatgccagctccggaagcgggtttgacatgtcgcctatggctggcatccctggtctcggtggagggcctgcggcaggcgggcctcctgtaggatccattccaggattggacagccactctggaatgctgcctggactgggcatgggaggaccgcctccaccaccacacggtatgggtcagatgggtcaaatgggccagatgggccagatgggtcagggaccacccaatggatttaatggcggaggtatgcagagacagggaccaccctttggtcaaggaggtccagggcaatggcagggaggcggcggtcctgatcggcaccaaggcggcggcggcaactggggtaacaatcgaggacggggccgtggcgggttcaaccaagatcgacggggcggacgtggcggcttccgcggtggattcgggcgcggcggcggcggcggcggtggagaaggcggttggaagaattaggtcgccaagctactatgtatcattatcacccaatatatgtcagtcgaggatgtttcgcctcgatcccttttccgcgagtgtgcccaaaggttgcgtctgttttctcctcagacaactcacagcgctgtactgttaaacagtacgacgcagtgtacagtacaggtacctgcacctgcacctgctccgtaacaaacagtgttgttgtggtacagtgtgctgggacggcttgccctgggacgggcaggagcagaagggggagggatgcgagggagcgagggcgatcgccttgcgctccctgggcatgggccgcgcgcgacggtgaggcttgcccaagcaggacacacgcgcggcagaaggtgcatgtgcgggcgggcgggctattctgccctgaaagaaaaaggaaaacgagcaacgagagagagagagtgagtgagagagagagagagtgagagagagtgagagagagagagagaaacggtaagagagagggaaggagggctggatcagacggcccacacacccgcctatggctgggcattggatggatgtctttttggttgcatctgcccctcctcgtctcccgtcgctgtctccttttttttttctttctctcttatttctctcactcttatttctctcactctctcactctctctgttctctctttgcccacataccgcatcccacatgcacatatgcgctccttgtgcctttgctgattccgttgcctgcctgcctgccacctcgccatccctctgcccattcgcaccctccgcaccccacccacaccgcctgctcgcacgcccgcgctcaccactcaccactctccactctccactcgccactctactcgccactcaccacggccacactcgcagcagagcacaggtcggctcagcacgaacacgggctcgacagcagcgacacgcgacagcgagagcgagagcgagcgatcaaagagagaggcgctccccctcgtagcggagacctttgccacacgcctgccgtccacatcccgcgcatcagcagcccagcatgacaggccacacaccctccgccatgctcatgcccaacccgactcaatgtaacattggctagtcagcgcacagaatgcttttcttgacactcactttgcagaaacacggcgcccttgactgacctctcctcttctccgcgttcctctttgctgggcggctcgtgcagtcgccgtgtccagagtcgccgtccacgacgttactgcatcgccgctgctaacgatggtggtggacccggtgtcttcggccatctcgattcaacaccccggtacggcgcaggaccagccgcagccggattatatccgtgatcccgaatcgcgccccagacactcattgtcgagtttatcgggctcgaacaaagacccgccacgtatgctgctcaaagtcaaggcaagggagggtctaaggctgtcgttcgacctcgcaggcgatatactagattccatccaaccgcagctgcaaccagagccagacaacgatcagctacctgagcaagaaccaggaaccggagcagcgacgcgaaatcttaatcaccacgacagagagcacggacttgatcctgaacaggatcggcacgagagcccagaccaggatgttctcccccacacggaggtcgagcaagacgacgacgatgacgacgaggatgagggcgacaacgacgacgacgacaacgatgacgatgacgaccatgccagtaccaatacccataccgatacccataccaatatcgagagcgatatcgatgacaaagacgccaaggttattatcgagactccttttctcgaccatatgcactctgatgagaacgatcgtggtacagcaaaggcaccatcgataacaacagcagacaaacagagcgtgatcacgagcccagacacgggatcaggacaaaggccaggctcatggtcggatacaaggacagacacaagcacttcaggggctagtgttgtcgcccctgaggacgcgcctttgaccctcatatacgcccccacaatttatttcgcagagacacgatcagagcaggccatgcacgacctttgcggggagtctgcattccaacagcaggtaattttactttgttggacacaaacttttactgatctgcaagctagagcaaaccaggacactacaaggtcatctcctcctcactcacctggcgctcttgctctctgcccccctttatgactcagctggcagagaatccagggtctataactgcgataaaagtggtctcgaccccagatgtgaatcagcctggaaagtataggcgcacgtgggaatggaactaccacgaggacgatgatgcagagattaggacccagagtcacaaagcggtctttgctgtaagcatgcgcgaccacatacatgctagctctgatttcaggatgccatagcggcgttagtgactaacacgataccaccgctctagttcttgtctaggaatctgtcgactggtgtgctagaagtcctggccatgttctcattatggatccaacgtaagtggactcggttctgaagcgtcccgtctgaatctgaatagacttctacgctggagagctcacttttcatctgtcgctcaaatagtggttcccggttctagaggacctataggggtacggtttccatctacattgcaaccacattctgcatggaatgcgaagcactggagacgaacctctactcctgagaagggtgcgaatgcaggccgcactccgtccttctggaacaagttcccagcattccccgccacccatcattcgttaccaagcctccccgaggcagcaaaagcgaatggcatggacgcgcaggacccatcagcagagccacgcagtggcatccatgcaccgtcctcgatacctcttgcaaacgacagtgaggatggtccactttttcgggcgacagtcgtagagtgcgaaaaccatatcagagcgatgagagcggtgacgaaacggatactgaaggctgcgcaggctgttatggaaactcgcaaggcatgggtcgctgcggaggatgcatttgttaaagagctggatggcctaaaaccagcagaaccactcgtggatctgtactggagacccatgtcgcaagacctcactgagcgcgcagaaatgctttcgcaacacatgcgagagctcctcatagaaccattctcctcattctatggcgtcgacatcaaggctgcggagctccatcggagggcgttcgaggaggagagcaaggagtattacagcttcctgggacggtacatgggcatgaaacaggacaaccctcagaagaaggccgacgctgacgtgaagcacgacaaaaagaggcgccagtttgagcgcaaacgtttcgaatactggacttttctgcaggatatgagagcgggtggcaacaagggcgaagagttgttttgccacctcaccagttacacagaaaagcattgtcagtacgtgactgatatgggtgcgatcgcggaggaactgaagccagatgtcgacaccattgtcagcagcaacaaggaacgccagataccgatgaggaagactcaaaatcgcttttatggcgctggtatcaggttggatcagtctagcgtatacacaaagagtactccgccttcggtgttgactcagtcagtgatgagttccacaggtaagggaggctatcgatagaggcttcaacacccacagctggcaacgtttcagcaatcgaagagcgtgtactaaaagcacttatggtatcatttcacaggatccgatatcagccaggcatcttcaagaatggcgcacccagaccagcgtctgccagatcctcggcagagcacagattcgatctttgaccgatccaccgtgcattcggaatcaactgccccttcaatcgtctatagcgcaagcaacgccagcactcaaagcgtgagtggcttccgcgatctggagcatcaagacatcgacgcaggactcgctatgggccgacgcaaggagggcttcctatttgccaccagtcgtccgagtccacacaatctggcggttcttgagaagccaaatatcaactggcacaagtactggtgtgtgctgtcggaaggacagcttcatgagtattcgcattggaaaaagggagttacccagcctcacaacgagcccatcaaccttcgcatcgccactgtgcgcgcctgccgtaatcaggatcgacggttctgcttcgaggtgatcacaccacgcttcaggagggtttatcaagcgacaagctcggaagatatgaattcgtggatcaatgtgatttcaaacgcaatccaaagtttattgaatggcaccagcagctgccggaatctcagcttacagtacaagagcagggataattacaggaccataggtgcacctgatgggaaaggtcttatggcgggccttggcggaatggcccgggctagcatggagcaagtcttgcagtcgacagctttgccagcgtcactgcaggagcgggttcagtacggtcaagccgttggaaggaagcgtgggggaggcgctatcgatggcctgaacgaactaggccagatcattcatccgttggcggcgcagcagatgtcagaggactcccagcaggatgcggatcaacttggagcgcgactgttgcaagttttgagaaacgcccatgtggccaacacgagctgcgcagactgcggggcaaaatatccagactggtgtgtcatcaaccttggtattctggtttgcatcggtaagagagggaccctcatatctgcttctccatgatcaagcagctcattcgcctttaagattgcccctaacccagccatgcgcttgaataccacgtctgttttcatctcgcgccattagaatgctctggtatacatagaagtttgggaacacacatctcaaaagtgcggtcattcaaccttgacaccacctcctacaccaaggacatagtagagttcatacggtctgtcggtaacaacatttctaatcaggtctgggaagccaaccttgcagacgcgtcccaagaagccgcaactcaggagaacgaccgtcagtcagcaaagattgtgttcaagaagccggtggttaacgactcccgagagtacaaggtcgcatttattcggaaaaagtacgttgacaaggcctttgtcaatcgattggcccaagcggaggcaacggcagccttgttccaggcagtaggctccaatgacattccggccaccattgctgcctatgtcgcaggtgcgaacctcaacaccatccaaagagccaatgcggaaaatgactctggtccttttgacgagcggatggatccatcaccacgacctcctccacttcctgcgcggaacagcgacacggctgcgccagggcctgcttccagcacagccgaggcgcctgctttgagtgatggtccatctgcggtttcaagtttggaagaccctgctgtattggaaacatcgacacaggcttccgaaatgctcgcgaacgacgccaacctctcagacgagcaggggcagcaacagcgcgatctacaagccggaagtgtgcacatccggccgagaccagctggggggcggcccatttcatccgtcatggtcatgcagacgtcgccactcctgatcgctcttcgtcatggggttcctttcagtttcgatgaacagtacgaggtatacccgctcgcagaatttctgatgcaaaacggggctgcaagcaatgcaagcatggaggtaaagctcttgaatggcactggtgtggcagcaacagccaccacagccaccacagccactactgccactagagcttcgaatggcggaggcacgagcaccccagcgccgtcgagcgcgcgtcaaacaagtccaaatgcgcgaccagagaaaccgtctcagggtctcattgaacgcgatgcgccttcgctgccatcaagttcgatcggatcacgattatccgcaggaacaagcacagccagcattggcggcatttcttccagcggagcatccatcagcagttgggaatcaacagaggcagcaaccggctccaacgacaggagcatcaacagaaggagtgttggtcagattgtcgagttgcgaggcgaggagggactatcagccatggagtatttacgagccaagggaatcgcccgtggtgacgtgttgcctactccttcagcatcctcatcgtcgtcaccagtacccactgccaacaactcgactgcgacttttggtggtcagtctgcgtctcaaaatgacgatatgggcagtccccgctccagcgctcagctggaccggcgaagtatcaatgggggaagctcttcaccctcaatgtccacaggattgatcagcatgctcacactctcgccgcgtgcccgtgctaccaccgccataacgaccaactctacaccgggctcaccatcagatccgcttgctactatgagcccagcatccagcagtgtatcccctggcacgaattatgatgcgcgaactagctctcctcggagcgccactacggccaaccaggacatttccgcattgttccagaagcgccgagagagtgatgtggggatcagctcgacgctattttcgaccatgaagccgccctcttccggcaaggacaaggagaaggccaccgcaaaagcgcaggcacggaaatcaggggacttttcacttttgcaccccttggcccctctgacggggtctcatggacccagcaataatagcagcaataccagctttgcggtatctccaccaccgacagctaaaacattcggcgagggcgccagtctgcccagcaccaccaatgcgaacagcaccttgagctcgcatagtgccaatagtcatggtcccagtcgcactcaaaaggtcaaagccagtctgacaaagagcatccggatgtcagcagcctactttaagcacaatgtcatgaaggatgaaaataaggacccacaccaagcctcgcccaccatgtctccgagcccagcagcaagtccgtccaagggcgaagccacccctcgggcgtccatctccaccgtagatctgagtgtggatggtggaactgaggatgagccgtcgatggccgagttgctagcccagcaggagcagcaacagcaacagcagccaccactgccgcaccacaagcatggacaatggccacttggacacagcttcatcgcatccaaacgggcaccctcggcctcgctgtttttctcggccatgacattctcgtccacgcccaacctctcccagcgtcaacagcagcaccagcagcaggcctatgccagccgtgaagtgcctcctccagtttaagctggatagttttctccgcagatgatctacaccataccaaaatttgatatacgcgttggacaaaaaaagacatagtttctgttcggaaacaatagtagtagccatatcagtaatatacctccagacgcagtttgtgcaagcttttccataggttgtgatagaaggtattcttttttcagagacgaaaataccgatgcaccgcagggttgtttactatggtgattatgaggtatggagggcatgtcaattcttttacgcagagatagactctggtacggcggtagtaggcgctggtgtggcagtcggctctggcgcggcggtggcatgctctggcgtggcagttggcttgggcgtgacagcaggcgcaggcagacgggcacggatccactgaatgtagtactcaatgacggccttgcgatcgtcctcgggctcgttgtgcagttcatggtaatgatcctcgtagaccttgtactccttgtccttgacctggaccttatcaaagaacgctttgcttgcctcgaaatccgtcagaccatccttggagccgtggcagatcaacaggggcacatcggggctgatgtccttgtagcgggtggtgagcaacagtttaccgttggtcaacatgtcaaagagacctttggtcgtgccccatccatggaccagtgggtccttgtcgtacttggccacctgctcggcgtcacgggagatgaatttggaggagaggttgacggggatcttgagcgagggtaggaccttggagacggctccacccaaggatacggagagccggttgggacgtgttggggccgaggccaggacgagaggcgcagaggcgatcagacccgagagtttggtgcgcagaggtccgatgcagtcgtaattgaggaccaatcctccgccctagagaaataataaaaaaaaaacgaaaagcgcgaggatggtcagtccatctcgcggagtacagatagaaagagatagagagaaagagagagaaaaagagagaaacagagcaacgatcaatgatcctggccttacataagagtgtcccatgaggaacaagggcacgccttcaatctctccacgctgcagcgcggccgtgatatcgggaatggctttggcgtacccgcccgagcggcccaaagtgttggtttttttacctgacaaaagcaagggtgagtaagtgggggtttggtaacagcagacgcgaaaacacaggtaaactacgtctagatggctcaccagtttcaccgaatccgcgctgatcaaaagccgagacctggaagccagccttgctgaactcttcgaacacatgatcatatcctaaagaaagtcagaagaacagaaagaggagagagagagagagaaagagaaggtatgtcatgaacttgacaccttcgacgtcccgttccaagtgacaaattaaaaaaaaaaaaaagaatgactccacttacgaacacagtgctctccgaggccgtggacaaagacgacagaggctttgggtgtgccgacggcataccaggtctttgtaaagatctcgtgtccgtcctcggccttgatccactcttccttcgaacgtggattttctgaagtagtcatagacatggtgtgcaatgggtgggatgagaaggtggaatgtatgcttttgaacggatggcagaactcgagtgcttgagccgtgtgcggtggcagaggtgagaggggagcccgaaggaagagtcgacgtgggatgaatgaaaggagtggatgaattgaatgaaataggaacgagacaagaggttggaaaagaaggagagtgagtgagtgaggcaaaagagactgagaaggttaaggtaacaaggcacacacaggcacacaaacgagcaagaaagacacatgcatgtgtgacacagaggagcagaaagaggacactctgctgcagtgtatttgggtgccagagagagggctctcgcccgttgttgacactgcgttgttcaatcatatgcgcctttgcgaccccctctaggcctcctccgcggcccctctgttgttgtctgcgcaaggtcgtctgccattgacttatgatgaacaacggcctgggcaaacaactttaggccaacgctctcataaaccctcttcctttaccctcgccccacggattcgcaaaaaagacaaccagtcttcaacccacgggcttgagagctgagaaagcgttgcacacagaccgtgccactagcatgtgcgaacgccctacaactgatgacctgactatcgtcgtcaaaaggatgcgaacacgaacatggcaaaagaaaaaagaaaaaaaacagaatggccgttatctcaaaaagataacaagtggttttcatttatttcacgccagcggtccgaaagaaacgggctttttaaacctcagcgagaatggtgggctccttgaagtccttgcgctcaaccttggcaccggtctcgttgtcagcaccagagtggagctcgaggagcttgccaagatcgaacttgggggccttgaggatcttaaccttgcggatgaaaacatcgcgaagggggtagatcgacttgcacgacttctcaatctcgtttccgatgacctcggggatgaacttgtggacgagctccttcaagtcgcaggaggtggcctgagcagtcatgatctcgaacatcttcttgcggatctgacggatctgagcagactgagcgtaggtggtcttcttgacctggttgacgcccttcttggtgaaggcgacagcgaagaggcggagcaagtaaccatcggtggtcttgacatcgacgtgggcctcgatgatggactgccacttgcggaccatggagcggagcttgtccgaggtcatgtccataccgtggaagttggtgaggcagttcttgccctggacctcatcgactctcagcttaaccttacggaacgagtactcctcgttcttgttcaagtcagcgagcgaaacctcgaggacacggcccttcaaggcgtcgttggcgttcttcataccctgggtgcggttgacgagggtcttgccgacctggcggacgtcaaaggtggaaggagccttgatatcgtaccagtccttgcgggtgaaggggtcaacgctattgtcgaaaaaaatcaagaaagaatttatcaacattgacgttgcggtcgcgttgactggtctgtgtccaagtcgtttgacctccgttggcttctgctgcgtcctgagggcacttgctgacgaccgcaaggtcgagaagaactgtcacggtgcaacgagcccgtccactaaggccgaaatcatgaaccaggcactttgcgctgccgccgtgtcgtatagtctgctccaaatcgacgagtccgctcccactcgcaaaaatgcatagatatccccgtcaataagatcaccacgctcattctcgacggatgcggtgtcgcccgaggagtgtgagcaacagcgcagcgctcggagcgagagactgatggcgtgcaacagcggtcgaatcgtcctgccaatccacaatccactttcctctgttgttgagtgctgtctaacaaagccgttgtcgtttcgaataccctactttccgtgagggtggagacacatgaaacgatactttacaccttcttcttaagacccttcttgcctttcgagagacgcctgaaaaggagagaaaaaaacaaagcagatgttaatgagctgaatctcagagcaggatcacagatttcatcggtccagtgttcaaccagtcaagatccttacttattctttccaacggctgtaagggcggatccagtaacacatagtgtggtgtgtgcggtgtgtttcgagatcgtcgagttgttgatcgatcagggcagttgacgtaaaaattttccccaaaagagaaaaaaagaggtggatggtccccagtgatggaaggatcaattggtttggattccgagagcgatcaaaagttgacaagggtcgatgatgtgaggttcgccattcaagaaaggagcaaccatttcgattccgagagcaaagagtgggttattgattcgagtccagatccagaacgagcgcacaaggacacagatcccgatttccagaggacacgagttgtcgatggcagttgagtcgatgtcgggtggtgatggtggattgggcatcgataaaagaggagacagatggatagatgatacactcgatggttagcaaggatgctggatcgatggatccacagctcaacggatgtctcccacagcaacagtacccataatgaagttgaatagtaaaaaagagaaggttcaaaccaccctgtgcacgcaaattcatatggacagcagaaacgacagcgtgtgcagctcatgcgatcgactgggtggcttgcgcgacacaccgctcgtttttagtcaatgccttcaggtgagggcacggcatcaactctagatccacttggctccacttggacacgcacacccccaaaacgcgatgcactgtagcaagtttttgctgcagagtgcacactgcccctcacaacagcaccctcatccttgaatacatctatagcactctgatgacggccatctcctgtcttggtgtggaggcgcctcaaaagcaagatctcggctcgcgtcatgcagaacctggtgactgtactgatgcgtcgctgcaccctctctgctttcataccgagaggagtcagcaagcagagcgagttgctgcctctcgcgaacacaaccgcatactgcagtggaggatggtcacagtttcgaacctcgaacgagcttgggctcactcgcgattgacctaatagaaaattataacacctatcatccaccaacctctattttaagatatgcaaaggacttgaagacgcgagctgcaccggctcagagggaccgatagggtttcgtgatcctggtgttgcacggcgggccgtatatatctcaaggatttcatcgcacctccgctgctttctctcttctcttttcccctcgaatctcaacctttcctcaccactaccacaacttttttctataccaccctcctcaccctcctcaccaacaatcaccatgaagttcactgccaccctcgccatcgcctccactgtcgccgctcttgccagcgctcagacgatccagatcaagtatgtgtcttgaaaaaaaaagggcaacacacggtgcgacttttttttctgagaaaaacgactgcagcattctgacgctcggtgtcctctcttccatttgatagcaaccccaccgtgggtagcacatggaccgtcggtgcgaccaccaactacctcggctggtctggcaactgtgccggtatgggcaactcctccaaggccgtggacgtcgagctcgtccagggacccgctaacatggtccgctatgtcgccaagttggctaccatcgactgctccggtgccaacatgagagccgatatcaccgtcgctcccaccatcgcctctggcaagtactccattcgcgtcaagacgaccccccaggattcgtacagcaatgagttcacgatcgagaacgctgctgcccctgctccccccgcaagcggtgcttcttccgcccccgccactgcctctcccacagctgcccctgcaagcgctgcatcctcgctcgctatcagctccttcttgggtcttgctggtgttgccgttgctgctctccagttcgctctttaaagaattctcaacacacataccgcatggagcgtacgcgccaactacaaacagacacgcactcaggagcaggagcttttctttccacaccacccggcttttgtttacgagacctcgatacctctcccgctctttaacacatattcaccacactacagtaatgatctaaaataacttggctctcaaaatatatcgaacagccaactttttttttttttatttcctggctctcgtcgcagacgatagttactgctcagatgttgcactcacatatgaacaattaaaaaaaaaccaagaaaaaagatggtctttactccctacgcaggccgtttgttctctgaagtggatttggtgttcttttacccggatgcatgcacaatgtgcgttcatcggatttcatctgagtgtgatacagtagaccaaacggggaagcatcggcccacaaatgatgcgtcggcacgatcacacacgaaaaaatgtgctcttgggtgaacttctttccccgacagcttggtactccaaactgaacattgcctctccgctctaaaaatgacagatcccattgcgcatctttacaaaagcatttctcggcttattgacatgtacggtacagggagtatggggacactgcgccctctgcgttctgtgtcggtgcccgaggatagaatgtggatagaccagcagcaagtgtcattacgccagcgagaggttgtaataatagcaacagaaaagctaggggcatctagcgacggtcatcatggactgtatgctatttaaaaaaatataccatcaagacccaggcccctgtcatgtttcgaaaaaatgatgcaaggtggggtgctatccccacgtacaagcaccaggggccaagtgtaagatttttgctagctctccgtgccagcctgatgtgcacgcagagcaacaccacgattctggtaggatttcacagacttcagtgccaatagtgaggcatcattaacatgcgagagatgatgttgttgatcgctcacatttcgttcgcttctctcagctctcaggcttttgagggtggttgtggtcactgtagtacacaaacgctatcgcaaaacgattcgcattcctcgccggtctcgagtgcaccgagacctggaggacaggcgtgggtgcaaacagctcagttggtgtctccagttgtctaggcctagtgatacgagaaccgttcggtcaaacaccttcgtcgcaaactgtgcagcacattagcttggaaccgacagagtggtccatgtgggttcgtgcttgtgctgcagcaagaagaaggtgtttttgcgcgaacaccgtacagcacatggatggcgctgactttggagaggcagctgctctgcgacgcgagttgttgacagacatgtgctcggttcctatggtcgtctaagagtttatcacagcgtcgataacgtcaacatcacattctccacggggagtggaaggggaagggagaaaaggttttccagcggcgaccacgaccgagagcgcatcctctgtgctatgatatttcgtgcccttgagagaacgacttttgtgtgttatgatttttttgtgtatggccgaggcgcatcattaagagaattatcacatttcatgtctcctgtccgactctcgttttgtttttttgccttttgcccttggacgcgccatcacccaatcttgcatcatcccttttttcctgcaccctgccctcctccgtcgcccttcccaccaccctgcgattcagcacctgtccatctgaaacgaactcacgctctgacagaatctcaggtaatacccacgatcatccccaggcaccaccgcgctccgcgcccatttcagcatgggtgactttttttcttcttccctctccctttccttatcatcccccaactgtccaaccatgacagagctggccactctcatggcagtcgatcgctgggcgtgcttgttttggtcgttgcgacgtgcacagtcgacgtagcgaaggagaggggacgctctagcccagaaggatgagctggcttgctcagtcgcttgttctctgtgcgccccacgctcatcgctcctggcacacacgcacacacctccaccgcttctctgctcctcaaagcagtcttgcagtcttctgtcgcccttcccatcgctccagtgccttcttttagctcgcatccacacgggatgtcttgatactgcgtttgtgtcgctggtgtgagacagacacttttttttttctgttttctctttcctccgttcctctgtcctctcgtccgcctccttcactcgacctgctcctcctcacacccgctcgctgtcgtctgtccctccatttttttttgttttccatatttttctttttcgtcccctttctccttttcgttcgtgctctcgcgcagtgtgcccttacccttccgtcccctccttggtccctttgcccccctgcccagctctttgtttctttcttattcccctccaccgcgcgccctgctctgcccattgtggaaacacgccgtatctcatatcgctctttttcgacaccgtcccaatcctagatcgactatcgtaatcaacaaccccattcctcatacccaaactttcgacctccatcatgagttctgaaatggcagagcgcatcgccaacgcgcgaaaggaagccgaattcctcaaggacaagatcagggagaagaagtcagccctgaacgacacctcacgtaaggctatgacggattctatgcagtcatgagaacaacgctcctcttgcactttctctgaactgtcaacctgaggcgcttttgcttttgcctatcctactctttcacgctcacctctgacccacccgcgcctcacctttattgcacacggtacttgatcacaaaccatggaaacttgtagtgaagtcaatgtcccaggaactcgaaccgttgacgcgcatcggaatgcgagtccgacgagtgctgaaaggtcatctggcaaagatttatgccatgcactgggcaacagacaagcgccacctggtgtcggcctcgcaggacggcaagttgattgtttgggacgcctacaccaccaacaaagtctatgccattcccctgcgctcgtcgtgggtgatgacctgcgcttacgcgcccacaggaaactttgtcgcctgcggtggtctcgataacatgtgctctgtctacaatctccgaacgagagaggggtccgtcaaagtggcaagagaactgagcgcgcactcgggatatctttcatgctgccgcttcctcaacgaccgccagattttaacctccagtggcgatatgagctgtatgctctgggacctggacgcaggaatcaagctcatggagttcaacgaccacacaggcgatgttatgaggtaaggcaaacctttcctcttggctctacttttttttttttttttttttattggtgaacaacttgcacagccgctgttctttcgggataacaactgaatatcaagagcgttaaaggctggcgggatttgtcaggggcgaagagcagacaaaacagggctacacgactttggtgcgaccaagcactgtggtccactcacgacggtgtatactcgattggaagttgcgcgctgatttgggcgaaaccgtgggtttcaaccctgcgtagtccaaaccggctcaagtgtcaatctcctgcatccgcactcccggctctcactaaccccgcctgctgcaatgtatctttcgccgtatttggtcttctatagtctgtctatatcccctgaccagcgcctgtttgtctctggggcctgcgatgccacatccaaagtctgggacatgaggaccggacgctgcgtccagacgtttaccggacacgagtcagatatcaacgccgtgcagtacgtaatcaccaacaaccagcagtgcttttctttttctcgttcgaaagaggccacaaaaaaaaaaagactgtatgcttatgcaaagcgtcgtttgtgtttaataggtttttccctagcggcgatgcatttgccactggctctgatgacgcctcttgtcgccttttcgatctccgtgcagaccgcgaaatgaacatttacacacacgacaacattctctgcggtatcacgtcggtcgccttctcaatctctggccgtctcctcttctctggatatgacgactacaactgcaatgtttgggacactctgcgaggagagcgcgtaggcgtgctgatgggacacgacaatcgtgtcagttgtttgggagtggcgagcgatggcatggccatgtgcactggaagttgggatacaactttgaaggtaagcaatcgctccatatctgatcgcttctgtattcgtagcgggaacaatagcttattcgttcgtttcctcgtcttctgtatcgtttctcctccactaggtctggtcgtaagccggttgttgcagctttattaccttatgacgaaagaatgagatactcgcgactcgtagtaccgcactcttttgctcgacgcaccgtcttcttttttatacttcttatttctactcttgacctttggtcagtcgcctattgcccatcatacctccccagaatatatacaccgacaccatatttcgtggcgttcctcctccttacccttctcctgtattccccacttgtcgtcccctccacagcaacgcataccaagtgaacacctgcctccttgcacccttatcctcagtgtcccagcctgcctattttcgtactatagtttttctttctttctttcttcaatacaaactcaaaggaacattacgcgcgactggcgcatcttgccgactctggtctaggagcaagtgtgttgttgctcatactcgggtggttctacatggataatgggcgtgccggcaggcttattctcggtaccccatttttgattgttggtggtgtgggaggtgacaattgcttggaccaactgtggcacttagtcatttttcatggggtgagagccacttgttcactttgcaatggacatgcaagcacgaggcggggtgattgtcccccaaaattcatagcacacctgaaacaacccagtctgcagccaatgaataaaaggggcgttacaagcagtcgagtttttttttttttcttggtcctgatcaacgaactcttccatccattccgttacactcactcacccactcgttgacattctcactcctagactacacttgcctctattgctacacaatacaccctctccacatatagcgcaactccaggaaccaccatggcctcgcactcattcgaggagaccacgcgacggtctagaaagaatggtcaagtaggcaggaccaaacctttggcgcatgcagccaacgatgcggtacacccgctcgacaaccaccgccatgacctcccagagaagcgacaccacgactcatcacactcggagacaagcagctcatcctcacgcacagccagccccacgctgcagcagcagcaggtcacccacataccagaactcgagcaaaactttgtcaacgaagcacacctgcaatctttccgccaagcaatcgaggacagcgtccacagcgaatcttccgcagagctcatctcggctgtgacagacttcatacccgtccaacagacaccaacgaagcgtgcacggcaacagcgagcacctaccaaatacagcggcttcagctacaccgttcttcgaataccgctgatggtatgtcatttacagtgtggcagcgtgatgtcatatatgcgcgaataagagggaacatgcgttaaccttgtactccttggtcgttgaaaaaatcacggtgcccatgccgtacagatcctgatctttagcgttattgcctttgagatgtggctctacgtatgtgtccggcagatcgtggtcctctttgagcacttcatctactggcgtggacggcgcaaccaacttcgaaaagatctgcggagtgcaacaacctacggcgaatggaaggccgctgcccagaagctggacacacatatgaagaaggacgaatggaagaacgaccccgactttggttactacgactatcgtctgctctccaaagtcaacaggagtctacatgtctccagggaggcagatcggatcgatcagctcaaggaccatcttttgggcgttgtcaggtcaaactttggaggcgttgagaactctcggctttactcgcaaacataccatggcacaaagaagccaattgaggaatatgtgcaagaaggtaaaatttgcgtcaacgacctaaagtgaaaagcttcttctacgatccctgaaacttgcatcaacgctcactcgtcaacatctcctcaccactgacatagtcacgacatccttaaaggcagtaaccgaatccaagcatctcacggacgaggagaagcggtcgttcctcaaaagcatcaacaagaactacggcagatcagcattgtgtctctcaggaggagcagggttcggatactaccatctgggcgtgattcgggccctcctccaggcaggtgtgttgccgacggtcattactggcacgagtgccggagcactacaaggtaacgaggattggctggttgcttgttgctcttaagaactttaaatgcatgacgggaacgaatctatttccaatgactaatggtgcattaatgctctatttctccactttgctctcggttgttggaaattaaacagccgccctggtttgctgccgtacagacgaggaactgaatgaggtcctggtacctgaacttgcatccaaattcacggcgtgcgccgacaatatctttgtaagttcatgtgcaggtgttcgcaccattttgttatatgtgtccgttggatctgctcagtcaactcattctgaacggactgtcctggcgtttggcaaatgctagacttggcttccgcgcctgattaagaaaggctcaagatttgacgctgaggactgggcacggaaggtgcagtggatcacgaaaggaagtttgaccttcttggaggcatacgaacgcacgggacggattctcaacatctcagtcatcccatatgaccctcattcacctccgaagctgttgaactatttgacgaccccagactgtgtcatttggtccgcaggtaagcatcagtctttggattaatgaaattgttctgcctttttgtaaactgttttgagctaaaatgtttttcaaattttgtgcatgatgtgctagtcattgccagtgctgctattcctggaatattgaacccggttgtgctcatgcgcaagcggccggacaactcgttggtacccttcagttatggtggacgaggcttcaaagacggctcactccgtgcagacattccgctccaggcgttgcatacccacttcaatgttaactacacgatcgtgtctcaagtcaaccctcatgtccacctattcttctacgctgcccgaggtagtgttggccgacccgtcagtcacacttatggagaggcttggcgtggaggatttttggcagcgtctattgagcagtttctgaagctcgacctgtccaaatggctcaaggtgctccgggacttggaattattgcccagattcatgaatcaggactggtcgtgggtctggctgcagaagtttgatggccatgtcacaattcttgtaagtcggggaacccttgttgtattcatcccgtgagcgatatcctaccggcatcagccaactgacgtttcaattcacttttggttctcgaatcttttagccaaagtctggtatttcagattggtttcagcttctcacagatcctgacgagaatcgattgcgccattgtctaacggtcggggagcgacagacgttccctaaactgcacatgatcgccaatcgattgaagatcgagcagtcgatagcgcaatgccgcaccacgatcaaagaaaaactcggtcacaaagcactgggacgcagcgcctacaactctgagctctcaagtattctttcggaggacagcgagaacactgtcaggtcgaggatgcgtgcatttggtgctggacacgactttagggaatctgtcgaaggaggctattccgccatggctgctgaacctaagggcaggagtaagcgtgtcgcgtcttggccaggtctgcgatatgcgctgggtcacgagtcggtgggtgactatggatttgcgaaagctcgtggacagtacgaagaggaggaggacgatgatgaagtagacgatgaggtggatgatgatgacgatgacgacgacgagggtatgggcatggattatcaagaaacttcatcgcatgactattagcatagatgaacttttttttttaatgtttgtcgctctaaattacactacaaatcgtcgtggagacgataggcaaccatggcatcgaccttgtgaatgtttgtactgaaggatcttagccgcacctgctctgcgttgtgtacgagatgtgggtcggcatcactccatgttgctggtacctcggcatccacctctgtttgacacaggatcgtccaggtgcctatgtgaaaaaaagcaggagcgagcgcgagagacaaagggcgagacatgggggtgtcattatcagaggaacaactcgtgccatgtaaagattttggaggtgatctcggctcgaagttcggattgctagacggtatgtcttgctaatctaacaaaggcttacatttttcatccagcatcggtaagaacgttacgctggcagtgatctgtcgtaggatggcctggatctctgattgaatctcctgttcagacttttcgtgttttggcgttggtgttgagggtggagctgtggcggtgagagaggatgcagatgagagagctgggtctgagagcgcgttctgctgtgctgtcgctgtgcgatccttgctgttttggatatcgaactgccagcgttcgaggactgccatcgtttccttggacttgatggccagaatcaacttttccactttgcatgccatcagccaggctacggatggtaagaaaggagatttggaccttagagatttccataggactttgttgtaaaagcggggtggcatagagcattagcggtgctggtgattataggcgcgaattcataccttcgacttgcttcaagatctcgcgcatatgactcttgacttcgacgctggtggtgacgagcatgctgaggccatacttctttgtgactttgaagtgttctggtgcgtagatcccgcgctggaataataagctattcccgaacgaaacgggcagaagtggccagttcgagcgtgagcaagagaaaaaaaaacgttgggttgtgaagctgtcgagtggtttttggtttcgccttgtcatggtctgttacctattgatgcagtattctgaacgggaggagcacgagtattgaggtgagttatgcatccttttcttttactcgctggaatctagtctttgtgtattccaacactgagatggaggggatcctcgagttataggacgtgagtgtgttcctgcgagcccttaccaaagaactcgacaatgatctttgtggatccacgaagggtgatttgattgcgactgttggtcgccgggtgctgttgcagttgcatcatgatgtcgagttgatgtcgttgcccaaggcgtctgctggatgttggtggtggtggtggtggtgcgtgagggtcttcttgttgatcgcagtggtcgctgttggcttgctgtattgatggaaggaggttggaaatatgaacgagtcgcgttcgacctcaggcttgacgccaagcctcctcagactgtctttttggtgccaccaatgcccttctcgcacttgcgcccgtcgaccattgctctctcttcaacactcctcagcgccacactcacatccacactgacagacacacactgacacacgttaactcatccgcaccaaccaaatgtccgtcaactgggtcatgcttaagcctgatggtagcgacattgtgccgctcgaaaacgagaccgtgttctttcgcgagagcggggtccgcttcgagctggacagctccaacggcggctaccccggcgctgggtaagaggcattacgctggacagccaaccctccttcgcaattcgcaattcaagtacaaaccactcaataacttttattcttttctcttcgctggcttgcatagcgtctcctatgcatcaaaaagtggcaccgtgctactaacgaaccagcgggttgtctacctatgtgctacgcctacaccggcttttagctcagcttcactgcccatcaaaaacattcaggacagcaagctcgtacagccttggttttcagctgcgactttcaaggcggtggtaatgccagtcccaggaggcgggctaacgcaaccggctcgactctcgattatattctcgactggaagtatgtgtccgccttagcacctcgctgttttttggaggagtgagaatccagcgacatccgactaacatgtcttggcttaatgactttgtgtaggcatccacgagtttgacgttcaatataggtcattgagggaacgattacaaggtatctataatcaagacgagatcatatggtttgcacgagcaccacgtatcgactttacgcacccgtagaagtctctagacatctgatcgttctcgctctctttttcttctttagagctggacggagttgccccgcaacatctggagcaattgccggtgtacctcccaccgtctgggccaccacctgaaccttcactcaccacggatacggtaccgtctcccacagccacagcgaccgccacaggaccagcacctcagcctgcaccccatcctgttccgagcggttactcctcggctcaagcctcttcaacctctaatggctctttaccgggaccggcaccaccgcaaccgcagcagcaggcggttcctttagatatgcctccgagttatgacgaaattcgatgaaaggaatcatctgcgcggacttgtccatcgcgttaattattcgacgcctgtggtttagagattgctccagttgaggtctaggaagctcatttatcgtaaatctagcaaccgaccttcgacgctcttgagtaaactgcccaaaatgtgtccacggtgtattgttttacaaggaattttcctttgacttttttattcatttggatatcgatctcgagcatggtagcggcaaatgtatgtgcaggtgtagaagatgaaactgtgtaatagaaacaaaaagggggagggggggaatggagagagagaatgtggcggcgtgagagtgagagtgagaaaggatgagatgttgatcactggtggttattaaactactgttactgaacagggtatggcaccgcgtccttgagtaactcttgccagtcgagtttggtgatttcggatccatccatcacaggccctgcgccctccatctcggtctgcactgcgatcgcgtagcagtggtctgggtccagcagggcctcctcgaaagaccagccctcttcaggaaactcggccgagggctcgtgcacctgcatcaccgtcgtcagcgttggctaaacaagaaaagcgagaaaattttgcggttagcgatcaaaaacgttattattgaaggaaggcactgattttccgcgttcacaagtactgaggatgtcgtcttccgcaatccatgcccaaggcccataaaagataacaccgaggcaacactggggttcgtcgcttccatacaatgatcccatgtggacgcgtctctctcttccgctgcaatccatgtccagtttttttttgtctatcgagtacatgcctctctacccaaggaaggcattttcgacatagacgtctcatgcgacactgcataagcttcaggcacatcggtcggatttttttgggctgaatactgtttatcctatccaagactccttttttttcgttccttctttctctccttggtccttgcatcaattgctgtgtctgtgtgcgtgtctgtgtgctgctgcatgcgtttttctccgctctccccttgtttttaacctgttctccttttaatcataaatcccgactctgcatgccacatgaggactcgctcgcgctgctgcagctgctgctgctgctgctgttggcacgttgctgctgcacgttttgctccattcgctttgctgataattgcctttttcctccgcctatcccgctccactgctgtgtgagatgtacgattttttttgtttgccccctcattctcaatatcctcccccaccccgtgtcctctgttcatcattctttttctttggtttccaatctctggaatgcttacctggatggtctgctccgtatcagggaccgtaaattcgaacgactttaggttaaagtcgagcccaacgcctaatgccttgacaacacactctttcaggcaccacattctatagaaccgccttaattggttccgcgtggccaccggtgcagctggatcggctgctgcccttttcatgaaggacatctcccttgctgaaaactatgtagtcaatccaatcggcgcgaagacaatggaggtgcaagtaaaacaaaaacatacgagaaaaaaaaggggggaagagggggagtagggagagtgcggatatgcagacatggattcacatgatgcgccatgacaatcaaaagtgtcaaaaaagaatggcgcagagtagacgacccaagcccatgcagatagaatttgtaggaggttcagtcagaaagacgcagattgaagataaaaaagaggcggagataatgagtgatgacggcagcaaaaggtacaaagcgtgtttgttatgcgtgtttgtcatgtccacccatggcaaaaacgcgagggcaggggtgggcgcacatgaggtaaaggggggcgtggagagagggtgttacacgacgcgaaatggcaatgcagtcgcgttacgcaaccaataattacaacccatcaaacaccatgacgacagttgcaacaacaggggcgagaaacacgaggcggttgagattgtcgagaacaaggtggttgccgttaccagcaggaggtgggatgttgcaatacgaatacgaaagaataagaaaacgggcagacgtaggaaaggagcaaatgagagagtaaagaacgaaaagaactgatcagtgagaataaaagtgctgcgcacggtgctgtacgatccatttttgaggcacaagctttaaactgctgtgtggtaaaagcaaagaaccatacctgctcgaggaacccagaggaaaaggtatcgaaggactctcccgggggctggtcttgaaagtccataacatccacgccaacgcggaccgtgctttcgagcgacgtgtcgccgacaaggagcacccagtctccatggtgagagatgttgaagctgacgtttcgcaagtgtgctggctgtacctaagatacaggaagggcagcgaaaaccgaggtgagaaagaaaaggttaatacgacaccgctggacacaagatttgctgtgctggaaaggatctggggtcacgacggagaatatgaccctggataaacagagttgctgctgctgctgcctttgctgttgttgttttcgtcgtccatgttgtggtgataagggttgttgatggtgttacttttggggtgctctcccgcgagggccatgacggcagggatatacatagacggcgcatagggcaaggggcagttggaaaacaaggttgtgcgctgtttcatcatagtctccactgtgccataacaacgaaccagggtctcttctagcctcaagaacaccaaaaaacaaagcggcaaaggggcgagcgagatgaagaggatgatcgcgggttgtgaaagactcttggacgatcgttcgtcgccgtccgatgatgcactgccttgcatgaccctatcccatccctcttcactgccctccttttaatctggacactatccaacatagacctttacgccgtgcccttgggggggtttttttttttttttttttttggacaccgccattttttccgttgttgagtccactggtccccacgcctgacagcctcgtccacgccgcaaaactcaaaacctcgagagacgagcggaactcaaacttaccacaatgggtttgttggtctcggatcgagagaacaccagcttgtcccagcgacagccgtggtgggcagcaaagaaggcatggatcatgagtcgtccgaccagagatcggcgcatatcgtcctcatgacggaactggaggatacgatcgcattcaatcttgggaagaaaattgaggagattggagagaggcacgatattgggcctgctgtcatctgtcaacgaggtcaccagaggctggacgtgctcgagcagcaggggttggcggatgttgaaggcccagcgtgcgatcggcatggttgctctttccttgaggtgtattcagcccgcggagggaaggggaagcaggggtatgcacgttgaactcggatgtcgacacggagaggcgctgcaatggaatgcggcgtgaaatgtatggaggaatggagttgtagtccgtcggggtcgtcaacggggttccaggatggggtcgaacaagagcaaagagcgtcgtttggtggggggaaggagcgattgcgagcaagcaggcgacaacgaagcgaaggtgctaatgctacaacggcgctgctgtattcggaagggaaacaagcgatgaaattatgctgctgttggtccgtcgctgctgagggggttttttttggcgggaaaggggtctaggcggagtgaggagcagtggcagggtgcgaggcagagcgaaggacgggcggggaagcagcgagtgctgtggagatggggtgcgcgaggacaatggaatgcagaggtaaacaatgaacaggacgagcgagaaggagtggaatggaaacagagggtgcaaagaagagaggaggggagaacaaagcgaaaaaagaaaaacaaaaacaagagaagagagaaaaagaaaaaaaaaaaaaagagcgagaaagagaggcgacatccaacttatagtgcacgccccatggcacatacgatccagcaggctgaaaagggactctttctccccttctctctgtccctctcgctctcgctctctctccctctctctctcccacggcagatgaacagcctgcctgtatcccatactctctctctctcgtctatgggccatcctgccgtcatagcgccgcggcccctgctcgttactgcatccagtgacgcgagagcatccagtccaggatcggcggttgattgccccgggttactcttaggacttcacagtaccgtagactatgcgatatccagctgattatgaaagtaagacgaatgaggacgggcaggacatcctttaccgtagcatggatacatgtgccatatataccctggaaattgattcactcccactgggctggtatacgcctgtccataggacttgctgtattcattgtgttcccgactagcattgcatcattatcctcaagggaggtactgcatgggtgacgaaccggcgggtgctctcatcccatgtatcgacatgatacaccaacgtgccatccgcctcattccatgaccagagggtacaagtgtacaaaggcggcacccgccagctaggcgagctggctgagtgagcacggagtccgaacaaagtcttctcgatgcccatagcctattgttgtccacatcgccacgacatgccctattctcaagccgcggtctcggccccccgttcagcacctcgcgcccaacttggctttcgggtcgtggaccaaaagtgtagagacgccatcaaggtgagactgaatgtctttgacagaaattgttcagcttgtcacatagccgcgtctcgtgcgcggtggcaacactgtttaccgcctccacgacgcgtttgcttaccctacgctcacgcggcctttgatttcgtcccgttggggcaggagggcactctgcgtgtatacattacccgacacctgcagcagaggcatagggatgcgctgcatgcccacactgctgcatgttagataataatcggcaagggctcctcaatctcgatccgcttgtgaaaccagaaagccaagcgaaaagcgctcccgaatgtgggctggaaaaggtcccgtccaaccttcagaccactcagctccatcccgaactggggtatctttatatacatgtagtgatgagatgagattcagtgatgactggcccttattttacagctctatagaatcccagctcgctcccctgttgtttcaactcacttctgtcgggtcatggtttaccacgtctcaaagtataagctcggtatttgcatctggcgcggaagaaaaggtctgtaggtcacgaagtccgcccaccttcggagttgtccccttccatccttggaaatggcagcttcagtgaccacgtgccgatatggcgtctttggaaatcgcctccgcgtccgacacgcgtacgcaagtgttcattccaagtgcaaacttgaagtgcaaatgtgacttgtctctgtaatttccattgtctgcaagcagcgtgccgaacctctcgccttgtctgcacacacgcctcattcctttcccccagccctgaccctgaaccctgaccctgcaccttgcacacgcgctgtctcgagcacaccagacgaaaagaactcaaagttaaacgcctagcttcaacacttgacacggtcgacatcatcggcaatggcatcatactacgacgaccacagtcttgaggatcctttcaaagcgcgtggagccaggaagaacaatggcacctccttcaaccctgacttgtcgcactttatgcctcacgaagacgacgagagtcatcaggaacaaccatctgcacggtcaccatctacctcaggaccgggagccaatgactttcgccgattggcagagtaaggaccactcacccgttttctatacagaggcggagagcaactcttgagaggcaccttcgctcagactgtttcggctgggattcattatcctttggcacttatgagtacgtattttgcattcgtagcatgctcggtgcattcagagtcagagaggagccactaggcgatgaagatcaccaggaatttcttgataacttgatcacgcaactcatggatgaggccggtgcaaggtacagccagacagagaggtctcaacatacgatatcattcatgcccacttcaaagcaccttgactgactcctcagatgatatccggggggtttcttttttattttagcggcaagcatggccctcccccagcttcgaaatcgtttatccgtgatctgcctcacgtccctcacaaagatatcaaaagaggtacagcgcactgaagtcgctgcagcagagtgatgttctcctttgcctttcatgtcatttaatcttgtttttggctgcttacatgtagatgaggcatgcattatctgcaacgaaaacttacaggagaatgagaccaaagccggaatcaccaaactgccctgcaaacacttttttgaccgcgactgcattgtgccatggcttgaactggtacgtatgggactagggcatgctggatattcgatggcctactgatgatatactttacctaacgcgcctgggctgatgcatgctgactctttagcataacaattgcccagcatgtcgagcagaagtcccctcagacgatccagattggatcaagaagaagcgcgacgccgagctggccaaatacgctgccgaggccgagattgacgagaactggatgtattcatagagccaacacgcagcaatagaagtgttgataaatgatactaagccacctgaaaatcatatctcacagggtgcaagatgcatccatccatccaatcgttccttgctcctctgttccctttgtgtatctggtctattgcatcccccttgcccctcctgccagccgctctggacctctctttcgtctgcttgtcttctatctactctgacgactatcacgacactatccacgaaaagagacgcatccccttccgaatccaactttattcaaccgactcctcgtcatggcttcggactttgctgaatgggtacaggagcagggctcgactgaagcgctgtaagtgcacgctaagcgcatccctgtcttgggacctacacttcgctacgcaatcccctcgccatgcgtcagatagacgcgtcttaccgcgagtcaacgcaagcttgcagaggaagcatcctttttcacttggcctaaccacgaccctcacacacgtgtagattggctcacgcgtcagcgttgatgactgtgccgtcaaaggaactcattcaccccgtcgaggacctcatacagtcggccctgatggctcctgttgagaacgactaccccagctctgaggtcgtgtcctttttaaaggctctcgcagaacgagaatcggaccagagtcatgtcaaagtgacgtccatgattgtcgacttgttgtggatgatggagatcgagaacgaattcgtcaccgcggcgcaaaaagagaagatgattcttcttaccaaggatatcattgtaagtctttgagcgctcacttgttgtaaatggatgcgttgtatttttcttgcatgttgtcgcccatgcacatgccaacgcgtagtttgtttcctctggccgcacactatgctaggcgcaaggattcatcccggtccgcatgatgaaagaacgctgggagatcgagttcttgcaggaagtgggattgatcccgaatgcaaaggcgttcctgaagcgcgttgtccgcatcaataccgcgcaactgtaagtttactttttgtaaatgtttctcgggccacaatgtccttttcccgatcctgttgccgttcgaaggaacacccagctcacgtttctgtctgacttcgcggctgccctcatagatacaaacaacaaaagtacaatctcctgcgggaagagtctgaaggctactccaagctgatcacagagctttctactggaactgctgattctgacgacgccatggagactgccagcaaggtggatgctgtccttactaatattatatcactcatcggtaagtgcactgcggagcgtctgccctcttttccgaggctagactgctcattgtagcctcttgcctctcaggaaaaagttcatgtccgcaccagttcttgcttctactcctcgcactttgatggattgactgattcactctcaacaggatactttgatctggacccaaaccgagtgctggacatcgccctcgatgttttcgctgccaacgtttcgacacatcaccagttcttcatcgagtttctgcgaaaatccccatggaattcacagtcgggcctgcaaggaattgctgtcaggaatcgcgcctgcgctcaagttctcggcttcaaattccaaacgatgcaggtaaggacagaagactttgttgaacgtatgatagtttctatgctgctgcaatcttctaactcaaaatccgaatcctgtcatgcgcacatcactagcgccctgaacaccgccataaatcgcccatcgagctgtacaccgttgctgctctgctgctgaagcattctatagtccatatggaagacatttacccacatgtaatgatccccatcgttgaccacattccaagtttgtcacaaagggtataacggccaacttttactaacctcagtgcttttacaaactcgctacatagctctccttatccgacgaagtgatggaaaaggaatacgcctcatttaagtcagccatgaaggataaggcaaactcattcaagagcaatccactggcggtaggtgtctctcattgttcattggccgcccttgctccgcctcagcgcacgctgtatatatgtgctactgacatccaccatgtatgaattggttcgtgctcgtagatggccggcgccttggtagatgacactgtggtcggagcgtcctcgacgaatggcattaaggatcaggcaatgccagatgccacgcaagcagaaaccgcaccagacctgcctcttccaaatcaaaaggttggggtggtgaatgctcttttgtccatcggcgacttggagaacgccatgtttcttttcgcgcgattccctaatttgacagcatcgtacccggagaccgcagatctgctctgccgccttatccatgtgatgatccagaatgtctacgcaccattttcaccagagacacgccatatagccctggcaaaggatcgaaacgcgatttatcgtcacccatccatccccaaggaccgagagagggcagttgtacgcgtgctctcacccaacctacccctcgccacatctactcagcgattcgaattcttttatcagggctggaaagataatatcaactgctgtcagagtgtatcggacatggtcgaacaattgcggcctctgctgaacattgtcggcgtccgcattcatcgggataccattctcgtgaccaagctctgtcgaatcggggcgggaaccatgggtcgccttcgcacagaaatcacacagcgggaaagggccatcagcgaaggtcatgatggcgaaagatcaagaactgacaatgccaagctgtccagcctcaagtcggagcttcagcacgtcgagaacgcatggatcgaaatggctggttccttgttcttgccctctatgtcactcacatattccaatccaggtaacgtgaaagcattgtgcaaattgttcgcatgagtttctaggccaagttgtaagtgatttcgctcgagactgaccacctttttaacgtttcatctactatcgcagggctggtcaatgaggtgtggcaagtcttgaagggcttacgatatgaggatcgctatagtctctacggcttctggaaagggtctgctccgaatcggtacccggaattacaagtggtcacggcagcaaccgagaaggaggcgaagagcgtgatgcgccgtattaacaaggaggatgtcaagcagtacggtcgtatgtttgcaaaatacgcgcattccaacccacagattgtgttcgcagctgccatgaagcagctggagggtggctacgacaacatggtgcagccgcttgtcgatgcttgcaaatacctcaccgacatgggacaggacatccttacctacgcactgttggaatccctttctaagacgacccggagcaaggttcaggatgatggtacatctcctgccaagtggatgataagtaagtgccacgtgccgttactacatgtttcttgatattcgcaccaaaatgaaacaactagatctaattttcttttcttgcacccttgcttttcaatagccttgtcctccttctctggccagctctatcgaaagtacaactcgccagatctcagcgggattcttcagtacattgtcaatcaactacggatctcgtccgtcaacgacctcgtggttttgagggagctgctggctaaaatgggcgggatcgaggagacgagcaacttgaactcttcgcagctgttggctatggcaggaggcgaactgctcaagaacgaaacactctttggaggggtgactggcacggtcatgaagaagaacggccggagttgtctgcgccttcaggaagccatgatgcgcgacaacattgccagtcaactcttggttctactagcgcaacaccgccagatgtccattttcggagacaacatggtgtcgcatctcaagctgctgagcaaccttttcgaccaagctcatacgacgttgctgcagttcttggagttcttatcgacaaaccttcataaggaatacccttcatttgtaccatcactcacagagctctgtcacgagtataacatcgagtccaatatcgccatgtgcatcatccgtccaaaacttcaggaactgatttcggttagtccatcaagatgccctagtattattctctcacctatcctccttgtctgatgtactgacgtcgttttgctgccaccgtttttaaactgattatagagagagcagcgactgaaggctgtgagcaagctcaaggcggacgacaagcaggtggccgaagcagcccctgctgcagacagttcgagcgcaatggatgtcgatggacaggaagcaaaggcaaaggatgagtcggctggtgctgcccaggtctggctcccttcacttgagcccatcgcggaagaggtcaccaacatactgccacctcgcgctttgcgcggtttgaaatcccagttctttgtgaccttttggcagctgacgctttacgacatctttgtgcccgtggaccaatacaaggctgagattgccaagctgaagcatacagcgcacgtcatggacagcgacaggacggtatacagttcaagtgtgcaagctaagcggggtagagatcgtgatcgtctgtttcatgccgctgccaggttggacatggagatggagaaccaactggcaaaccacaagagggtcatggagagacttcaccgagagagccagcattggttccgcaatcgtaagtggcacgctccttttttcttgaagcatcagaagtaggccaggcttaaaacatgagatgtcgctgaaattaaacagtaactaactattcgttttcgctccctttgccgtaccagtgaaatcggaacgtcaggaggtcatcaaccaagtcatccaccactgtctttacccgagagccatcctttccaacctggatgcgctctactgcgccaagtttgttcagctcatgcactccatcggcacatcggacttgtcaactctgacactttatgacaaggtatgtctgcgtgtccataacaagacaatgttcataatagcagctcccagacgaaagcgagacctatatctaacactcgcccgctatttccatctcgtcggtagctgctattggagactgaccgcgtgattttcctctccaccgagagcgaggctaaatgctacggcggattcttatgcgagatcctgacgaacctcgccagatggcatgggagtcgcactttgtacgagaaggagggtcgcggtgtcgacttgccaggctttcaaaagaagtggagcccgaggaacgcgagcggaaagatcaacgaagaggatctactggactacgaggactttcgccacgcgctctacaaatggcacaccaagttgtacatgggattgtcgaacgcactggagtcgggagagtacatgcggatcaagaactcgatcatgatcttgagagaaatttcgtcatgctaccctacgatgattattattggcagtcggctgtttgacaccgtcaaggaaattgccaccaaagaggagcgagacgatctgaagttgctggccaatgcctatctcggtgtgctgaagaagggcaaggatagcggagcctggatgcgtgtagctcaattccacatacccaccaacaagggagatggagcctccaaggaagcctcgacgcctgcacaagcaccagcagcgaatgggccctcttccactcaagccaggccaccgtccgcaagacagcccgactccagatcggacgctagagattccgaggacagaaggtatttaaagaggactggttgcaaaacgtttgccgacatggcagactatcgtcgctgccatcgagtttgttatactcattttttttcactctcacctgcttttgatgaaccgtagtggccgctccgcaaccctgaacaccttgtccgctgcaaactcgactgttgttcagggatcgagggaccgcgtgtcgtctattagggacactcgagtgggcggcaccgtttcccctggaggaccaggacgtaggaatgtattcccattgccaccaaagccaggcacgccggtccacgaagggcggctagacgctccatcgattagagattcacgagagcagcctgcaagggattccagagactcgagggaacgagagcctcaatcctcaacgcctcagccgcgcgctgagaagccactgctggtgatctcgcttaagagcggggcctcagatcgtgatactcaagagagcaaggattcgaacaaggataccaagagcgatgcggctagggagagcagcaaggacatgaccaaggacaactctagggatatgaatcgggattcgactagagaagtcggaacgtcacaaggaagagataaccgtagggaaggcgatatgtccaaggagggatcccgagactccaactcgcgcgaacggaacagagatttcacagaggactctgatagagactctcgtggagaaaccaggagctcctcgatgatgtctcccgacaaccgcgaccggcgtgatcccagggattctggccgcaaggatcttcgcgatttggcgccccgagacccccgtgacagagattcacgagatatgttacgaacggacagtagagatggacgagacggacgagatggacgggatggtcgagacgctcgcgatggccgcgatagtcgtgatgggcgtgacacccgagtaggtgttgcgaacgcgcgcgatggccgcgataaccggacgggtgcctcagttgcacgcgatggccgcgatactcgacaagacgccccagctgcgcgcgacggccgtgatactcgacaagacgccccagctgcgcgcgacaaccgtgatactcggcaagacgtttcaactgcgcgcgatggacgtgatactcgacaagatgtgccaactgcacgcgatggacgtgacacacgagcggatgcctctactgctcgcgatggccgcgacgctcgaacggatgcctcagtcactcgcaacggacgggacgtacgtgagccccgcgacggaagggagggcaggatgctctcggcgccaaaggacccacgagacgcaggccgtgaagacctccgagaaggaaaggatggtcgttatggaggatcccgtaacaactcgcaaagagatcaagcctccgacagtccgagagtctcttcatccagaaacaatggtagtcagggtgagactgcggcgttgcaaggaggcggcgacattagctatgatcgtgatagagagcgtctccgcgaggatagatatcgggaggacgaacgtaagaaccatggaagggagaccaccgatagaaccagggagaaagacattgcgttggatcaggaaaaatccatcgagcgcaacggcgatcgcgaaaggagaacgcaggggcgcgacaagccacgcgacaatggcagggacctggcagcgtctgaaggtccttcaacaggatccaacagagaacgaccacgcgctgaaagtggctcccgcgatactgagcgacgtgccactgatagaagagacaaccatcgagatcgagaggaaatgagtcgttcaggatcgttatcctcttcaaggcaagactcttcaagacaagactcgtcaagtcgcgatagggacaggcgcagctctcgtcgccagggttcaggaggggatggtaagacttttggattatgatggcggctaagcacgtttagagcacatgtgatcttttgtgataatgatactgatgttcatactgatctcatgtatcgtgacggacgcttaggtgagggcaagtcatcctcgagagaatctcagggaaaatccgatcgccgtggggattcgaccgagaggaagcgcggacgcggcagcagagatgccagcgttgacggtgaaaaggattccaagcgtcatcgcgatatcgcctctgccagcgagactgtggtaggtgtaggtggcggcttcttgacacggtcgtacatacctgtgcatgagtttaatggacggagggctggcatcgattcagtcgaaacggaaggtcttgtttctgacagttattccttcgtgctgcacattgtaggatcgaagcagtcgcagctctagtcgcaagcgaaagattgaacccgatggtatgttttataccgccgtactaatcctttgtgcgataatgttgcgagcagcataggacatggctaacgtttctttccatttcttttctcactagaccgcccttcgtcatcaaaggatcggtccagagatgatccttcagccactcccaccgacaatgcagattccatcgcgatgccgccacctgtccgcaccgaatcaagtctttcggtcagctcttcgttctcaccagcgtcatcgtcaggcatcgcaacctctgcacacgtaaggtttatgtgcctgtcagtgttcaaagcatgtttatctgtgcggtacttggtggctaatcatactattcatcattaggcttcaaatgcgaagtcggctgataccacgccgccatcatcaacatctggttcgaagcggatcaaactgaatcgaccttctgataatgacagcccttcgcgatcgcccctacccagcggtgctggctcaagtgagtccccatcatcgagaaaccgggacactgatgcatcttcaaggccgctgcccgagatgggtctccagaccagctctttccggtcccgatcaggagacaccagacggccagacaggattgactcgtctgatcgtatgagacgacgcagacgttaaatgtttaaagagagtggcccacataacactatccacgtcgtgagtgccgatcgtgtggaaggacaatgcgtcccgatatagccaataaaggcactcgatgcatacatcgtattgaatcatgtttggcaagactatctgtgtattcaggtttttttatcaaggctcctcagatgtaaaaaaaatatcctacgtttgtagtccgaggttgatgtttctcctggccgaggatgatgatgcagtgggccctgcctttggctcagtcaggtaagcagcgccacaaacgatggccagaagcacgaaggtccacttcatcaaggacagcactgcgatacggaaaaagttctttgcgctcgcgacgatgcctcggtcctgtccgtgtccttgaccgtgatcagcatagtttcctttgtttaactttctaaaccgtttggcgctctctgcagcctctgcgtccgcgatcttgagccgtttcagggcatcgggtcctggccagggtttgtttccctccttggggttcttgcacgcaatctcgatcgagtcgacgactgccacgtactcatccaggttgtctggcccgtattcggtccgtcctccggcccagtccattgtcgcggaggaatggcccgcgtcccagatggtgatctgcaactgcattgaattctcaggcaggccaccatgagcagcagcatctttggcgtgaacggttcgcaaaacgttgccatcgacggaccagcggatcatgttttcattccactcgatcttgtagaggagctcgtgtttggtcgaatccttcttgagctcgaaggtttcttcatgcgcctccagacgcgattgcggcgcatgtgggtgcgaatctgggttcatgtctgggtaggaatgtgggtccaggggtgttccttccttgtgtgagagcggagggtgatggtgaccgtgcgaggaggagccatgctgagacgatggagggtcttgctggcgaatgcgtcgatagtagttagtaatgactttcttgggatctttgcccgtcagctcaaaggagatctcctcacccagcgcagggttggaaagtaggatggcggtgacgatgcccggcccggtcgagcccgatttgagctttacggagaaggacccgtacttgttccaacgggtggatgagacggtagcaccgaaccccccgccgctttgagttttgaccatgtctctgcattgcacaaagtaatttcgtagtcaacgcgtaattgcacacacattacgaaatagggcaggaagccaaaaaaaaaagttggtatgagctcatcacgtcgcaaaggtttatgcagttcaagtgattttttttccgtcgtcatatatctcaccttcgggttcgaagcagaagcttgtgctggtgatggtcaatcttggcataaggcgcgatatgatgaaagtccgaggtccagtatgtctggctgggatcgccgttgaaggcacgtttggggagcacgacactctggtgtttgaagtgctctttgatgtttttacaggcgggtaagggaaagcagccatcgagatgagagtatatgggattgcatcctaaagagatggggcatgcttccatggatgttgtgtggcaggttccgtctggcacgatatcgagcgagggagaacaagtggaaaagaggcgctgttatataaacggtacaactactgaaaacacacgaggactcaaggcctcacgaatgaaggcccaggcagtattctttttttttcttcttactgttgcagcatggctcagcggcggggcagggcatatgatgggggccgcaataggagctttcgcgggtggtaatggagtctggaggatgagggcggtgttcgcgcccaaagaacgagccctcggccaggtgcgtgctgtcgagcggccatggtgcgaagggcaaggataggaccagcaaagagagtggcaaggatatggctctcattgtagcaggtatggttgtgcgtgcgtgtgtgtgagtgtgtgtgtcgaaggacaagagtgaacggctgcagagaagaaatgactcgtctggctgaaacgggaaaactttttatattcgaggtcaaacgcgtgcgagacgtgatcaagccactgctggatggagtgccaaccattcgtctgcccgtcgggtggaggagtcgagagcgcgccatcgatacgcaccacgcacgagcctcggcctggaaaggcgtcagagccgagtaacctttcctcaactcgggtcagcatgattacgtgtggctttcggtggaggagagaacgctgtgaagggcgctgactttgcgtcagtagatgcgctacaccgacagaaggcgctgtcaggcatacgctgccttgttcactattgtctgcgctgactggacccacaaagcaaggtctccctgccctgcgtggatgcacgacgcagggtcgtgaaaggcggggcgaaggacatccacactcctcacccctccgtctgaaattcgatttgctgagagctaagccattcgtcccctgtatgatgcatcagcccatgcgggttgccgatgcccttgtcttgactccatccgcactttccctgctgtcgctgctgcatccttcctccgcccagtctgcctctgcccccccacccctgccctcctgcatactcgcctgcataccctcctgcataccctcctgctgaccccccatggctgactggcacacgcagacgcacgagtctgcatccgacgacgactttgcaagcgcatccgacggcgagcagccatcgccccaggacaagtactacacctcgcgcgacagacacagccccccagcagcgactcctgtgcaccagcaacaccaccagcaagagaccgtcgggccagcagtgtcaccggcctcaacgccagcacggccactgtcgcactcccggcgccagctaggtacacagtcaaagcaaagcagcgcgcatgcgcgacgcgtgccttcctcgcagtccgcactgcatgctaccatcgactctcctccagaagcgcaaccagtggcaccattcaaggcccagacgtcaacattcgcacgcgttgctgcgactcgagaccagtcaccatcacccgtcaatgcagcgaggaccatgaccagatctcaatacacaggcgccgcgtctgatatgcctcagagcagcaccacgccgcccatgtttgctcaaaacgatgcgcctggcggaaggtcggagggaatcaactctaagcagcacttcagcaacactaacagaggaggtgcaacctctgggcatgaagcatcgtcacggaccgagaccactcaagaccagggccgcggttggggctcgttcagttcatggatcaacaccgccgtcagtacagtcagtgtggtgatggaaaatcccaacgtagtagtatccaaggctcagacaatcggtaaggaattcgagcctcgcctaccgctccgttgacacgttcgactcacctcttccctgacacgaactgtttgatctaccgccggcgggatacataggccagggaattcgatccgtagccacggagcagatcgatcgcgtttacgaatctctcgaccccgaatatgagtatgaacgtgagcggcaaaagcagcggacccagcaggagcacactcctcacgcatcgacacaggctgcgagcattcatgataatctctttgccaacacctcaaactctctcaactcacagtctccccgactggaggcgctcacagccaacaacaatgttcctgtgaatcagcgccatcagatcaaggaaaacgagcctttgagtgggctcgccaatagcaaactggcatacaaagatgagagagccgatcttgactctgctggcgacggctggggtgatgacgcttggggagatgattggagtggccaactggatgctggcatttctgaggatcgaccgagaatcaatgatctcggtattgcaacaaaggatgtggcacctgctgtccagctgccatcaccactacctgaggttacttcacagacgcatcagcaggcggcgcagggaccatacccagcacgcaaatcactcgatcggccagatcgcacctcaagtcctatgaaaattgcaagagacttgcattcggaggaaatcgatacccaaacgtcccctccagcaagccggacaggcggaggactcaacatcccatcagcatttggggatcaaggccggtctgggtttccggatcagcaatcacagaggcgcccttcgtctgatgtatgtttttacggcctgaagcattggcatgcagttgacaagacctctccagacaaggaaggactaacaccttttgcggcttcttcaacagctcaggccagccgaggcattattctctacactcgactttgcttcaaatgctctggggagtgccgtccttggtgtgcatcgcaaggttacacaggcaagtcctacgccctcgtcaagaagcaccccagcaccgaatgcgcggctcattcgaccctcgtccccagccactgccgagcgaatgcacaacaaatcctccagtggaggaagggatatttcaggaaccatggatcggttggcaatgtcaaacccttcactggaggtcgtaggaggaaatgtcgtgagcacgggactaggagctttggagagtcttggaaagagggctgtcgatgtcatttcggatgtggtacgtctagtgttgtatatcattcacgcgactacatattatttacgtttacctgcctgctaacttttgctaacactgtcctattttcattttgactagagacgcgcgggtcatctttcccaaggtcagagtagctcgcaaaattctgatgtctatgatgaaaacaatgcgttcaaggtaagaagcgtgaaggagctatacattataatgatcggatcgcttggctcacgaatctgacacagtgtatgttctctttttaaaccgtatatggcaacagatacccccacggatgagctttacgatccttgtggatgaggcagggggaagactccatattgtggcgacacgagctctagcgtctgctgccgccgcaagggtcgcacccttggctgccggtcggaaggaggtgctggaaatgggtcagcttgacgaactggagcaactattgcaacctgagagtttggactcggccatcggtgagctgtcggtcgacctcttagcaggccacaaagattttcgtgccatggtggccctgttggaaaagatgggcgttcatggcacaacccatctgcggcaacttcgaaattgtacgcggaagctaggaagcttagtggccgataccgtgcacgcctttgagcaaggtaggagtgtgcttgctctctcttgagtgacgtatgggtgttcgaggctggtttttttttttttttggctcttgcgaacccttacgctcactgcacaatcgctcttgaaacccctctctagaatggcataatcaccaatcaagagcaagcgagaaggacttttttgcaagagcgccgatcaaaaagtttttcgagtccaaactgctctccatttactttgatggacttcgagccttggctcagtttacagtccggacctgtgaccaggccttgagaatcgccgagaccctcaacgttcgcgtggcagagaagacaggcgcggctgtctcctcgacagctccatcggaaggagacgagcgggaatgccatcctccgctagtactggcagcagtgctgcggcagtttctgggcagtttagttgctgtgagccttttttttcaagactggatatggagtttagcctggtcgaatgcgaaacgacttgacactcaccaccatccaatgacctgatttatcttcctaggaagccaaatttgttgccaagacatatcatcagactatggacgcgattcttgtcgccgctaaacaattcaccaccccgctggacaacatggactgggaggatctcagcatgggtgttgacaagatcaagggattactgacaggaacagaatctgcagaggccgtaggattgattcattccgcgaccctctgcattctcgatgtcctcaagcatgaattgatgctggacgccctccaggggaggatcgtccccaagactcgcaaacctcagatcaaagcacaacccacgccgccgcgagcgctgccagaagcggcctctgtcgaggctgtcccaccgagactattgtctgcggcgtcgtctggacgcgacacgacgccgtctcggcctcgcaacaaccctccacccaagcccaaggtagtcaaggacgacgactttttcagcattctgaattcatagcgactttagaaaatgatacgtttctcggcacatatttttacaaggtacattgcggaaggatgattaggctgctagagtctttatttgttcgcgaaaggatacacatacgtattctgcacggcgatgacctcgcctcccttgactatccaccagggacgcaccagaggaggaagaaggtttcaccgccaacagagaggtatatgatgcacgaaatgccttcaagaaggcagctagcgcgaatccgaagctcaaaagtggacaacaagcattaggtcaaaaaaaaaaaaaaaaaaaaaaaagggaggaagaaaaaaaatggcggcgggaggtgggaaaggggactagaggctctatcttacaacaacgggtagtgggggcaatgaactagggctatgatatttttagtatctgccgttcatgttgtcgttgatctggctcttggagggacccttgccagatctgtgcttgataccgtcaccgggggcagtgacaccctgcttatggcccttgaagtcaacaatggcaatgctcttcttgggaagcttgccacccttgactccggtcagacgaatatcggcgcagttgtggtagtactgggcgatttggttagcggtccagctatttcaggggtgagtggggataattagagtggatgttagtggtgttacagacaggggaacggattggaattgggggtacaacgaagcgacacattctgggtctatttacctccagacaaacaagcacttgttcttctccgtgcacgaggggacgttcttggggattctaacgggccacttgtagtaggctaatgtcggacgaggagggagcaagagcgcatggtgtctgtcagcaacattgtccgcgtgttcattttgctagatgattgaaacacacgcgcagaggcagtaggtaggttaagagcgtcttcttaccatcggggcaggtcttggtgtaacgaccaatcaagtggtaggtctttccaccatcatacgagagggagaactcgcactattgcgcaagggagtcgcatcaaaaacaacaaatgacgggatttgtcagtatggatggaggcaagcgcgtcatcgtttcttgaagcgcacttcaataagagaaatttccttacagttcctccaccgtgacgggcctgggagaactgtttgttggggctggtgggcttgggctgggtcttgacgtccttggccttcatggccgtggcgtggaaacggacgggaatgacctgtccggccttcatcttggtgacggggccaggggcaaaaccaccgcaggggaagcgcgtggtccacttcgagtccttgtagccaatgaaggtctagtatatcaggggtgataagcaagatgttttttttttggtgagaaattagccaacaggaattcttgttcatccgtcatgtttatcctgctctggctcttctttttttctttttttttttttgtggtcgacggcgcatgaattggggggaggacgttgatagcaggacggcaacgacaagagaaaaatcattcaggacgtttaagaagggcgcggggagtgggggggcgcaggtggtaatggctgatataaccgctgagggcgaatatcataaaatgaaaagggttcgctattgctgacagtgaagcctatgcgggatgcgtgtaggttatacaaaagttatatatccgcttggctaatacttacgtggacacgaccgttgtactgcttagtaccgtaaccaccgcggggaacggggtacagaagagagccgtgggcagagaccgaagcgatcaacgcgacgagcacaataagggcagctgagaacttcatgatggaacgagaaggtagcgagtgtgtgtgggggcggagggtgtggaggtgggggtggtatagggactgggggtcgttgttttgactgggagggtgttgcggaggaggaggaggaggttgatgtcaatcaagtgtgtgtgcggacgagaatgccgaggggacggggcaagaggacaaaaagacgaggagagaagaacgacaagggaaaagaagaaggcgaaaggtcaagcgttgccgaattaaaaggaggaatgaacaacagcgcaaaaaaaaaacaaaagtcagtagactaggctactccgtagccgctgggtcgatcatctctcctttttttacaataataataaaataccgcaggcgcgatagttgcgctagcgtccctcacggcagaactttgattgcgtttgcttctttcggcagatgcacaagtgtgggatggagagaggttcctgcggcgacgcgttacgtacagatgtcggccagcgaaaaagaatttcatcagcgggggaggggcaatgcctgcaccgcaaaggctatgtgtgtgtgtacctgtctgtctacactttgcgtgctctcatcctccgcgatgtaagcaaacaaacggcatgactgtaggtggactacagtggcaagcaagcctcgtctgattagagggttatgtgttgtttgaacaccactagaccactgcacatagactggtagtcgtcaaggcttattgacaccggagaatacaacaaaaaaaaattgtttattggaatcaacattttggtgagccccctctcgttcttttccattccttctcgtctcacctcaactctcacggcctggttcccggtcaaatttccttcgcttcgcctctcgtggttttcagtaggggtgcctcaacgcacgtttgtgataatggctgcctccaaaagtgtctgaaaaatgaaaaaaaaatcaaacgagcgatctgagtcagctcacgtcagacgcggcggattttgttagccaagattagggatcggacccacgggctgggggtggttgccgtgccacagctgaacctgacggcgctacatcctgtcactcgaaggcacggcgttgttgtgtgagacaagtgtcctgggagcgatgcagcgtcaacagggaaccacagcaacagaagaacaagaagcgttccatagacttcataccagagacgcgtgctagtcccctcctattgattgcaatcaaaccctgctcagagagagggaggcatgcacacccgcgcggtcactgtatcgactgctgtatcgattgcgagctgagagaaaggcaggaaagcttgaaaggcccatgaaatatgaaaagaacgctaaaacggtgtgctcataaaaatatgagagccgtcgaagtgaatccccactgttttatccaccttttttgtttttacacttcggccttcctctgacttgggtttggtcgttcaccaagcacctggacctcacatctcataatctcacaaacacacccctgttcttgggccttcaaggggtgttagatatatacttgaatgggtatacatattaagcaaagtactgtacacggatcggggatcatgaaagccgccgttagagcactgggtgcatgtatcacattttcatttgtcgcgtaggagggtaaagaccgtgcacccacctcctcggtcgtggcagcttaactgggcattggcatgttatcaggctaggggtgtttggatcatcagcacacgaaaaggtgtttggcagcactgtatttatccctccgcctcggactaataaagtaaatcttcaacatattccgcaatggcaagggatgatgttaatccgggactttcgattcctccaagactgacatatccgctgcactgctgaatgaaaaagtctcggaagggctgcccgggacctgccaacttgggcctacagcacgtaacagcgacatgccgcggaagaacgttcgtttaggatctatcatactgtactttcaatgccgcattaaactaaaatcaactcacaggagagatgcaatcttttttttaccttatgcctgcatagtccgcatagagcgaggatggcttgacggctggaagataagtttgaatgactttggagacggtctccatggcccgtggcgagcccacggtggcagggtctatagaatagtcgtcaagacgatcgacgtattcagtatctggaccaaagcgcatccggccagccagatcgagtgtgacatgcgttccaagtccagcaagatccttgcacgggaccgggtatatcagacgagagacgagagccggcccagaatagccgtagtagtgacccttgcaataatgcagtttaaatggtctcaaagcggacgcgtccccatcgtcatctcggtcagcttcggccactgagctggaccgtgtgttcagcatgttgtcaatcttgtcggcatgcagtcctgcgctgttcacgactgtcgctgccttcaccgtgacaggtccagtgggtgtgttcatcgtgactctgaacgcgctcgcagatgtcgaccgatctggggtacccttccaatcagctgcctctcggccacctggccccagcctctcgacattagtgacctcgcactgcaatgcaaggtctcctccgtggtgctgtattctcgtctctagtagctgcatcagttcgtgaacgtccacaatccctgtccgaggcgaaacgagcgcggctttgccttgcacgtgtggttcctgagcgagcatttgcttgcgggtcaacatgaaggtgggtggaccgggcatccgcttggtcggcagcaaaaggccctgagccttcttggagaggccctccagatacgtgagatcgtcgtcattctggccgacaacccactttgtcgtctgatggtggccaatgttgtacttttcacacaggtcatacatcatctcgctccctcggatgcacagccttgtcttgagcgagtcggccggatagtacagcccagcatggatgacttcgctattccgtgagctgaacaacgagaacgttgcgtaagcagcagagtatcatgccgaaagtggaatggagaggggattgtcgcaagtatcggatcattcgttaccttgtctcctgtcccgtaccaagatttttgtccaccaaaagtgtcgaccctgaacccctagctgccagacgttccgctattgccagacccacaacgcctgcgccgataacgagatggtccacttcatactcaatggtctctggtctgtttcccgagactctgttcaatgacaaatgactggtgtggatccgccgtggttttgtcaggcctaatgcgttgcaggacccattcattcgagaggacgccccgtgcgcagtgcacactggtcgtagtcgcttcgtactgctgccgatggtcctggtgaatcgcgaaaactcgataggtgacttcatgctgcaggtcttgttcagattctgcctcctgattccgagttcctgctacagtatccctgtccgttgttctgtgggtgatgaatttgtaaatgtcgttgcaagggcctgctaggtgggtccaagtccccttaaattcttcgcgagttgcttcgtccactgtttaatgactctgtaatactttcgtcaagacgctagactaggcgcagctgcatcctcgtcaaagaatcgagtcgcccgagttcagaggtgtgttcatttccgcttctctccttgcagtgtcacaacaatccgccgaccagaggcgtggttacggtgctcgcagagccagatcctacagaggcggaaaggaggggggcgaggagggtagtgacggatagagggtaagcagaaagtcagccgtcgagtcacaatccttcagaaaaaaaaaagtgcacgaagccaatgaagagatcgtacccttgccatgttcccaagttgaagcgcccgttggtaatggggatgttgagggagacaccgacgagggtgctcttgaggtgcccggtcatatcgtctggaccctcgtcggtgtgcgtgaaaggcatggactctggtgcgatctcgttgagtgccatctccatgtcgtctcgcacgtcggggtctgcgttctcgttcagcgtcaaggaagccgatgtgtgttgcactagtatacggcatgtcaaagcaatgatgagtcctggcgtgtcggctgcagacagagtgcgagcaaagtcgattctcgtctcgggcgcctactcacaaaagacgttggccatgcccacggtaaactgcctcagctctggcagctgcttctcgatctcgctggtcaccaggtggcagccccttgcctttgcagggaggcggatggtggtctgtgcccaggacattgttggcttgaatgggtctgggtgaacaaggaatggaagggctgtgagagaaaggatccacgaattccgtgagggacgattttttttttaatgtttcacgcggcaggcgacgcgataaatttcctatgggcaagcgagtgcgttagtcgaaagaaggcacgacagcgcatctccttcagttctttttttttcgcttaccaagtccttggagcgatcataatcgcagtatcgacctaaactggagtagtcgatcctctgtgcttctagcaacgaggaacgccccatccgcttcacaaagtagtcgtgcgcctgggcgaccacatccaactcgtctagtgaaaaattgtacctagaacgaaagcagggggttctagcatcagctagggatgattttatgcgttgtatcgcgcaccgttcgccattctctcacctcttctccatagtcaagaacgccactcgacccttcgttctgcgtggatggtcctcaggcaaaggctcgcaaagtaaccgttcgagacaggcaacaagagcatcggtcagtgagtcatcgtagaccactgtagacaatggttgataatgcatggcaagtggttagtcagtgtggcaggtcagcggcaagccctagtatgccatggtcgcgatttttcataccatcggccgcaaaaataaaggctccctttgtcctccattcctcggcctccgtctcaagccaatcgaacctatctctctgatcctccaagggctgcatggggtcttccatcaaccagttcaatctgcgggccttgattcgtgactcaaagggtaccggttcaggctcgtcgcgtgctcgcacttctctctgtccgttgtaaatgatgttggccgcgcagttggatagaatatctgaatcaaagtctacaaaaaaaaaagagacttatcagtgtggaagcagtggcagcagaaaagccatttgcgcattcttttggcaccacgcagcctattctgagaggatgcagtatgactgtacctgtgcagtagacagtgctcacatccgtcatcagtcccagggcaatgctcgcgaggcctgttccaccgccgagctcaagtaccacggcttggttgagttgatccttcatttctatgatgtagtccaccaacaggaagcagcccatccagacttgcgatcctatacaaatgcattagtctaggcactggcactgtgttacagactcaacgacttaaaaatatgtaatacactaaaagatccgtcctgaacttaccaacttcgcgcaaggtcgtgcccatggtatgctgtatctcgacagcatggtcccaagtgtctggcacttgatcctcgtcttcatcgcttccatcatcggatcttgtctcttgatgccggtcctggttggtatggctgagcaggaagatcgaggtcagccaccgcccgtccacacgtccgttttccgggtgaatgtgaacttccgagagcaccatctcgtcctcatcggcttcttcgtcttgtggatcaagcgcatcgtcgtgtggactgcttctcagtctcgggctagaccttttgcatgttgtctcgagctgggtttgtggagcccggtcattgtcgctggagctttgagcctgtggggaatccagatcaggtgagctgcatctcgctcgtttgggctgcggacgcagcacgtcaggcagttcagagtcggagtcgcaggcgcgggggtggtttggtggcgagggggtggatgcgggggctggatagtgcggtgttgtggccatcaggaagagtgggccgagatgcgaatggatggatggtgtgtgtcagcaagaacgcactagcgtgcttgttcgcgtaaaaaagaaaatattggccaaggaagggggggaccctgcccgctttcgcccaaatgcgctcgcgaagcaatataaatacttcgcgggtcgtgtgtgtgcaggctggtcgtgtccttgcgctgcttgctgctgttccacacctcgataaagagcagcctcgtcgcgctcccctctcttcgctgtctttcccgtccgtacgctcttcctcagtcgtcttcagtcgtcttcagtcgtcctccgtcctggccactctgcgtcctccccattcgcctggactgccgctgccgcttcattgccttgcattcgccattctgcactgttccttgtccttagtgtgtccagcctccattcctgacgcttgggcctcccctttccctcgtcctcggtccctcgttcctgcatggccttccttcggtctcctatttccgcacatgtccgttacacgcggctgtggaggtcaagtccacgctgtctggtcctgaccctcgctgtttccttcgtcgtcctcaactggctgttctaccatgccgtgccgtgtaagcgtgttgttgacaacggcctctttccctacggtcctgcctccctcagctccgccccaagagaccacgcctggatgggaacttcaccagcacacgcaaatgaaagcctccccgactggtatactgactggatcaggtggagagggctcgaccccggctatgcagacacggctgccaacgctcaaaagatcgacatcgtctacacctgggtcaacggctcagatccagctctgcggcgcctgaaaaaagaatatcaggagagatcgacactctttacgcaggctggagtaggcgacgacaaggcgatcgcggccgtgacggccaagcggtttagggacatggatgagctgcgatactcaatccggtccgtggccgaatatgcaaggcacatgttccgccatgttcatattctgatgactgaggtagacaacgagcgccttgtgcacgtaccggattggctcaatctcacggacgacattgtccacccagttccccatcgcaccgtcttcaggaacagctcgcatctgcctacattcaactgcctggccatcgagagccaaatgcatcacatcccagatctaaccgacgtggtaagtggacgcgcgaggatgtgtgtgtatgtgtgtgtgtgtggtgagtgtgtgtgatgtgcgtgtgctgtggtgtatgcgtactgcgtaacggcagtatggagagccaggagaggtgatcggattattgttacgccagtaaggggcataacaagaatagaaggagaagagggatgagacctggagggcacatggttgcgcatccaaggagccagtgcaaaagacgtctggcaggctactacttcaggctgctcactggagtgctcgggctcgtagagtgatccaatgaactcgtcctccttctacaaatgtaatatgctcaccctttgtataaaacaatgactccttagttcgtctacatgaacgacgactttttttttgggactaagcttctgccctcggacttctggaccgcactctacggctttgtttttcacatggaaggcggtctaagggtgccgccggtcattcggcccaccgagaaaaatccggtagacattggcgaatggagcgctctccagtacacaaactttctcttgtcgcaacgctttggtcctcgctaccgtgcatatgtagcccacattccgcatgtcttcagcgtatccatactcaacgagatggaggatctgtggccacaggacgtggattcaacagcctctcatcgattcaaaggcgaaggcgatgcaaaagatattcagccatcgtttttcatggcccacttcgtcatggaacggctacgggagactcagctagagtcatattggctccatcgactggacgccaaccatgatggtgatctcgactggaaggagcgtgaaaagttaatcctgttggtgcagacctggaactcaaatcagcagcaggaggcacatctgaggcagaaacactcgcgaccaaccatgactgcaggctatgatggcgtcttgaggcgtgctggtgtcccttggagtggatcgactgcgtaccgcctggcaggaatggatggctaccctttcttgtccaaggacgccgacacgtcgagaactgtacctcttgtcccaacattgaacgcaaagggagagcaacagccaccgcagatcccatattcgaattatgagccgccagaggccagaacctgcaagctggatctggcattctgtcttggacacgagtttgttgatcctaaccacgttgccttgacaacgaatgagactcaaaggatctttcaacggctagcattcgaggagtttcattgcggcgactgtttactccaaatcttgacgcagcaccctgacgctggcgtgagcacatggatgcctcagaacgaacactcggaggcttttcaagacgtggcgcgaaaggtagctcgatataactatgtgctgggtacctccgactatactttcacggcgcttcagagagtggacgtagcaaaaaagagcctagactggcttctggaggagaaggagaagaagaccttcttttgcatcaacgataactaccttgacgatgaaaatttacagacccaaatgcgcgcggtgtttaaggattttctcgacacgcgctttacgacgccctcgccatgggaaaatagaacgaagatctgcacgtgacataaagaatttatattctcgttcaacgattttttttgtttcctcctcttgcaactgtcggatcactttttgtatgtcctgttcggtcgtataggaggctggcgggtggatggatacgcggcaccgtcaacggctacgggacatcctaaggactcgatgaactcgcagcaacgtctcctggatgcggctcgcgcatggagaatcgaccgatggataggtcttttgggcagatggatggatattctgttgcagtgtagggtgagcagggtacatgggatactggaatgcagtcaaaatccatggggaaaccatcatttcgatcggtcgttttcaaaccaactcagatgaaggctctcgacaggagcgatgtgtcgacagggcgaggaggcgaaagaaaagacattagggccattagacctaactcgctcccgtgttttgcctgttcaacgccttgtagctatcaccctaacaacgatagccatgtctggattgcctgctattctcaaagccaccgaggaggacatcaagctccttctctcggcccagtcccacttgggaaccaagaactgcgatgttcatatggagccctatgtctggaagcgtcgcgctgatggtaaggccccttgattcgaatccagggactggaggcaggcgcatagtggagctggtgaacacagcacgcacacatcaaacgtgagagtgtgagatggccattcaatggaggaacggacgcgtcgactgcttgtctaccaagctcatccagctgagcgagtgcctatcgcaaagcagcacagagacggcgcgagcaggtggctctcaagcagctcccacgcgtatccccaaagctgacatgttttcactcgagactaactgctgtgccacccgacttcaacaataggtgtccacatcatcaacatcggcaagacctgggagaagattgttctcgctgcccgtatcatcgttgccatcgagaaccccgccgacatttgcgtcatctctgcccgtccttacggtcagcgtgccgccttgaagtttgcctcccacaccggagcccaggccattgctggtcgcttcacccctggtaccttcaccaactatatcacccgcgccttcaaggagcctcgtttgatcatcgtcaccgaccccttgaccgaccaccaggccatcaaggaggcctcgtacgtcaacatccccgtcattgcttttgctgacaccgagtctcccctccgttacgtcgatgttgccatccccaccaacaaccgctccaagcactccattggtctcgcttactggttgttggcccgtgaggttctccgcctccgtggcaccatctcccgctctgctccttgggacatcatggtcgacatgttcttctaccgcgatcccgaagagaaggctgaggaggaggccgctgccgccgctgccgagaagggcgttgagggcacctgggctcctggtgaggctgcccccactgagtggactggcgacgtcgccgccgctcctgccgctgctggcgactgggctgacagcaccgctgccactgctgactggtctgccgagacccctgctcaggactcgtggagcgcttaaactgcatagtgttctctatgatcattataaatccgagcatgctcatgattgtacccaattctcttgatcgtcccttggtcatttcatttgttctggagtttatttgcggcagcgattgcctagccagtcagtacagacgttggggacacgaacgatcccgcggtagtagagggggctggggcggatagccaagtggaacaggttgtggtttctggtgtctggtttcagttagactttttttttttttatttcatactacagtactaattcgcagttttgatcgtcataccacgctccagcctctggctccgctctttctctgtccaactctatcaaatccatatcgacacgtaaactccccatggctccagttgatatgacgcaggatatgctgcggaatcttacgtccactctgaaagcagagggctttgagcagaacagttccagctacggccaagtaacacggaaacaagtgaccaggttttgcagcagcgtcgtgagggtgaaggaatgaaaggatgaaggactaacgcaaaacgcggggaccataggcagccacattcctctctgctcgaatcctgacagttggaggtgttgccttgttactgctcggcctctgtaagtgtgcttgcaagtcttcacacctctcaatcaaaaggagtgatgaacgacaacctccccaaccacccaaccactctgaaagacaccggcacaccgcttcatgtgctcttttttcttttcttttcttttttttttaatcgatcttcctcgatgctgttccgtgtaggctgtatattcgcagtccttgtacgcttcaatcgacaacagcatcgtcaggaactgcagagagtcgtgtatgtgcagactcgtgttctcgatcaaagctcgattgacaagtcgttccctatccgcatgtggccgtcccaggagcgcttgatgcaggatgaggagaggcgtgtgagggcctttgggagcgctgatgcgtctctgaaggcgacgacagcacccaagaatggatctgccatcgtgaaggcgcaatggccaacctctcgcaaagattgcaggtttctactgaagggcctattacctgcatcggcagcagcagcagcagcaagtcgaagcagccagacgaacgagacctggccaaccccgacagaaggctcgatcccactctcatccatacccagcaacagcgacggggtccgatcggaggctgcagagccaacaggtggtgttgacgggccgcaggacgcttgctgttcgatctgtctggccgagtatctgtttgaggatcgccttcgcgtcctcccctgcggccacgagtatcacgcggactgtgtaggcaagtgtgggatgcaagcttgcatacatgtgcaaaaacacatgcgattgtgtttttttttgacaacctgtttatgtgctatggggctgactttcactagacacttggctgatatacaagtcgacgcaatgccccctgtgcaagcgcgaccttcttgaggacgtggggaccagtccgccagcgagcagatggcctgcgacagcagcagcagcagcagccgcactctgagcacagctatagaagcgcgactctgctagagaacgcgccgtgcagagagtgcagtgataatgtggtcggggtggggtcgacggcggatgtgttgcctccgcgcccgtggctctgtcgagcacatgcctccactgcgcggcctgtgctctacacccctgtcgctcaggtcatggcccagcgcgctgtgtgtgcgccaaaatgggagcgttttcagggaccactttttgctgagcagccgctcttgtttcttgtttccttcacacccgcacacacgctctctccctcccgctccctccttcttcgccctctccccactctactgcattcaactcgattgcattcgactctgctgcatccgactccgcctgcattccctgcagtcacccccccattccctctaatcccccgtgcgtctatcctggctgaatccagctctaataaactcatggcgaccaaactggctgggttcctgcggacaatggtccccaaggtgcccttgctcatcgccaccaccgtcacccactactcgtacgggcccgcaaagccctcgtggccctatcgcctctccatcatcgtggcgctgctgcagtcctttgtcggccacctcaaccaggtccctgtccgtgaatcgcagaggctgtccaggatctcggaggagcacgcccctatcgatcccggggccatcgccaccgagaccaccgtccccaaccactaccgcgacaaggccgccgagcatctcgatcgcatctttggccttcaggggatcgatgccgccaagcttggctgggactggaagaacgatcctcgcgcagaggagcccctgttgggcgagtggaccgaggcaaaggcaaaggacgaaaagcactctgccggtcgcacggtcctgtatctccatggcggaggctactttctctgctccatccgcacacatcgatgggcgacttggaacatggctcgtcgtggtggtgccagagtcttttgtgagtgaaaagagtgattgtttacccgtccttaaacctgttttttaagctttttttttttgacgcaggtttttgactgaccgaaaaagcaaccactccaccacagcgatcgattaccgcctagcaccagactctcccttcccagcagcgctccaggatgcggtggctgcgtacctctacctcctgcaccctcctgctgactcgggtgccacccctgtcgacccaaaggacattgtcatcatgggcgattctgccggcggtggtaaagtttttatttgaatgctgttgctgatgttgttgttgcgctttctgttgcttgcaacaaaacatggcgtgcatgaagcacgcgcttgggcgattgcgagaaaaggaggaactgacgcgattgagatatctgtgcctctagggttggcgtttgctactgtactggccatcagagatgctggacttccaatgcccgcgggcgtcattggctggagcccctggtatgtggccattcctatcaaagtgggaaaacgaggagacgcatccggtcaaggatggcacatgccatgcagctaacacttctgtggtcctgtgcgtgcacataccgcgttcttactcgtctaggctggatctcttgcactccatgccgtcgttgttatcgaacgcgcgctcggattaccttcctgcagagggcttcacgcaagggggacaggcttcgctgcagaagctggccaagcttgcagccacgttaaagcccgatgatgtgctcctgcaccatccggagctgcctgatatccagtactatgccagcaatgcagtgcttgactgcccttatgtcagccccttggtgaccaagagcctcgagggcctgtgccccatactggtggtaagtgccatgcatcgtgtattgctcgatggcgtattgaaaatgaatgataccttgaaattgacgcgcacgatgcaccgatctttttttttttggcctctccctattgatcatggacgctagattgctggtgatggcgagatgttgcgagacgaagcgatcgtgtttgcgcggaagggtgtggactcgtccgtggacgtgcaccttgcagtgtacgatgatatgcctcatgtgttccccatgtttggcttcctgtcgagtgcagaggatgcgatgcagcagtcgggccagttcatccgccaggtgacggtcggaggcgagggcgtggctggcagcaagacccttgtgcgcgtggcagtggatggcaagcggcggccgctggaggacgatgctgtggctgcatgggagacgcgcgtgggcaagctggggggcggacacgacgtgcttcaaaggctgaatctgtagtcgagtgctccgacacctggatctggaggcagtctatccatgttcccgatctgtaggacccaatacacatatacccgtacttggaggtggatatggctaggtcccgaggcgagggtttgttttgctgtgatgaccagcgcggtgtgtcacttcgagagagcaccgaagggtgcgaggcggggagcgagaagaatgagaatgtccctgtgcgcttgcataaaagtggtcgaggtgcgtgttatggatctttgggccagtcggtgatggatcgcataagcaaagagcgcattctgctgtccgccgtccgctgtccgcgcatctttttcctgccccgacacctgcatttcccttggaccatctctcttttctctcgtttctctcgttctctcgttctctctcgcctatcgctctcacggtcccgtcctcctggtcctcctcctcctcctcctcgtcctcttcctcttccttcttctttttcttcttcttcttcctcttctcgatcctccctctctccatcctctgcaactagcacctgcttcaagggacatctttcccgtcaatggccgagcacgaccattcccacgagcagactccgctgctccaagaccaggaccaggaccaggaccaccaccacgaacacacccagaacctggtcgagggcatccgcaatgtctttgagaaccagatccccaatggccaccacaccaccccgccatcctctcccaaaaagatccacgccctgctgcccaggctcttcagcctcctgaattcgctcgtcgactcggagggcgtcgaggacgacatcatcaccaacgaggtcgtcgagttcctcgccagtctgggcaaggaggtcgtgtacgcccttcttcgctgtgtcgaaacctttctggacgagggcgagcacgacgtcggtcgcaagcgtttgctggagcgccgcgcggtcgtcacgcagattgccgccgcggctgtcgtcaaggtctttgtcaagaaggacatgatggcgacctactgccacgtcctcacccgcccctactttgcggtcgacgaggagtccaatactgccgagaacgcgatcgagatcgccatcagagtccatgcgaccgactttctggccgatgtggaggtccagcgctgtgtccaggcactgtggaacggcctgatcctccaaacagaggacgaccagtgtcgcgtgcgttttgtcgagtatagcggtgtgcgccgatcgcgccacaacctatgggagtggatcgacgttggtcgcttgaatgtccccaagtaagaaacaacacttgattcagaccatgctctctcactttgctgacgatggccacggtcagggacagtgtgtctaatattcattctcactctcaggtatcagaacaacatgcgcattgccatgtttattgtcttcttgatgttatacacgtacatcgtgaacgaccgtacaccagaccccaccatggcagaatgggcactctatgttgtagtctgcggatacattttcgaagaatttcgcttggtgagtggatttttttagctctgtaggatcaggactttgtgtgcacaagaccgacctttttgttgcggcgcgatggcttaccgactcctcgctgatagatttttgaaggaggcacggcattcttcctgggcagcatctggcattggatcaacatcttttcatactcggtttttattgtctgcttcgctcttcgcttcactgcccactaccttgttcaggacaccaaaaccagccaggagtactcaaacatctcgtatgacctcatggcgttactcgcagtctttttatgggtcaaaaccctgtcccttttggacggcatgcaatatttcggtatgtgaacaggacggatgcggttgattttcatgaactggacaaagtataacggagctgcaagctggacctccatcccttctttccctacttaccatcgcattgcttctaataggtacaatggtcatggtcttgcagaaaatgctcaaggacggtatcatgttcttctggctcttggcctgggtgttcattggattcttccagagcttttatgcgctgaatgttgatgaagagaagcacgcagccaacgcgagtaaacttctcatccgtggattcctgcaggatccagactgggacctcgcattggaacaggatgaagcatatgggttctggctctttgcactgtacctgttcttgacgtccatcattctgctcaacctgttggtcgctctcttcaactcgtcctacaccaacatcacggactcgtccgagaaggagtacctggccctgttcacgttcaaggtcttttcctacctcaagtcgccggacgagtttccctacgctgcacctttcaatctcattgaggtctttttcgtcattccttggagcgccattctttccaaggatgcgtaccggaagttgaacaaggtcgtgatgggttttttgtttggtgtgccggttcttgtgattgcagtgagtgaacgcaagcggtacctgaagctcaagaacacggatgacgagaacgatttccagggcggtcgccgcatctaccgccacttggccgcagaggaggatgatgtcgatgacctgttcctgctggcgacacgagagtttgaccccagttcggacgagtccgcgattccttcagccacagccgcgaccatcgctcaggcagaggagggcatcatcaatgcaggagcacaggacgctggctggaagtcgtctcagtcacctatcgagacgtttgaggagttcagggagcgtcgcaagacggaaaaggaagccaaggcagcggtggttcacaaggctgttgacaaccgtgtcttggccacgggtggatcatccagcgcgaccaaagcacctgcggcagtggttgctgctgtggctgcagaaacgggttcctctggacagttgaccgagaccctagttcagtcgcttcttgccagcttggctaggatggaggagcgtcagaaggatctggaggccatgttgcagactcacatcgatcgggagaaggaggtcaatgccattgcacaggcttcggccgcggcggtcacggatgaagctgaagtccctagcaactaggagggaactagtactgtacatgtacaagcaaagacactacgtacccaaaggtatcttttattgtcttcgtttgtattcgattcgatagatcaaaacctgtgcaaccaggaggtccatgggaaactatggatcctccgcacgataccttcatttttcataaaaagtcgacccttcagtatcccttcagtacttcagcatccctttttttttctttttttttttattatcttgatgatcattatttacacgctggagagagctgagagatattattcaataccagtcaaagactgagaggcagttggcggtcctggcattgtcggggtcgagctggttcagcatccagcgaacgacaactttggagccgagcatgagcaaatgttcaggaaaggagacgccacagaggtcctggaggaggacattggtgacgccggggctgtgcgagaatgtggactcgtaaggggtgatgacctcgtcgtagcgcgtggcaatgtaggagtggatcacacccggggcggtatcgccgccagcgttcagcttctgcatgaagggagagtctgtgatcatgtcgtagcagcccttgcagaacgcgtccacgacaggttccaagggcttcagcagacccagcgcctcgcctagggtcaccaaatgggagagcttcgtgccgtgtgtgatcgcgctaatgcctaccattctacaccaccacagatcaaccaaaggaaaaggtaataggaaaaaggtaaaggaaaacgttagacagagaaaattaaggttgccattcaggcacaaagcagaaagcaacaaaaaaaaaaatctccctcgtacctgttcactttgccagcaccgtccatgtacttcatccagtagcgggggaggatgccgccctgggaatgtccgacgacatcgacctgggaagtattggtggccttgaggacgccattgatgaaatcaccgacctcgcgtgcactccccacgaggtcattgacgccagcaaagaagggcacgccctcctgacgaccgtaggtgagcgcaaagacacagtaaccggacttgaccaaggccggtgcaaacagtgggtgccatgattcttccgtgaggagggtcgaatgcaccaggaccaccgcacgcggatgagcacgcgaggggcgacagttgtaattgttgagacctgacaccaccgtgggtttgtcccgcatcgggttcggcgcattgtagggcagatggggcaacgcaggcagcgcatgtgcgacctggacacaaacagagagccaagcgagggccaagagaacacggctggacagagatcggatcattcttgagagggttgagcgagaaggaagggggggggggggttgtatgtgtattatgtacagtgagaatataggagggtatatcgcgagataaaagaggaactatagctaatcgtgaagggcaaaaatcagagacgatcaaaaatgagacgcaaggccgttacaggagggaggggttgaagaggtcggagggatgtgtggatggatatttacaaccgagggaaggcgagaagaagaaggaggaggaggatgaggagatccggcggtaggggaggggagggcggggagggatgagaggggtcagatattcaggaacaagaatcgacaaggagaaaaaaaaaagagagaaaactcgagaaagcgggccatatttaaacacattttctctgctctgtcgtctttctcgtctactctgccgaaaatgcatggtgttgagagtgagcagcagaacgaaggaagtacacttgcgcggataaagttgtggagagagagagagagagagagagaaagaggtcgtggagaacagctgtacacagtacaagcgacgactgtggagggcccaattgtccgcctgtccgcccttgggtgagcaccagtgtgggatgggagtggacgatgggacttgagaggggtccgcatccaatggcgcatgatcggagtccaaggcggatggtgctcatgaagacacgaagggcgcacaaaaagggtcgaaaacgtagtggatgatgaagaggatatgcaggcacctcgtctccgtcagccgccttgcagcaatacagaataaaaaaatgcaattgcgatcgtacaagtgtctttcgctcttttcagtcgcaatcgacagcgtgcagagaaaaaaaacaaaaaaaaacaaacagcattatagccgacaacaaagagtggtttccgcatactgaatactacaccttctctctcacacacgattctctgttctcaattctcgcagacacatgtctgccagggaaaaagatgcaattgaaaactaaaacgacttgagagcagcagcgcgatggagccaacgcaaacaacaggcacagaaaacaatagtccccaataatgaatagagtaagcatctccaggggacaggttgcacacaaatcctctacaaatacagagatacatgttatgatgcctgtttggaggggacggatgcatggaatgcaattacgttgttattgattcgaaaaagggcgtcagataaaaaaaaaaaagaaaaagaaaggcgctggggggtatcactcgctggctatggctctttgtcgcgtgtctgtggggagaataaagagagcagcagtcgatgcgttaggacctattgttaagcatgagacgacccaaagtgctcttcactagccttccgtctcgtctcctgacacctctttccgcgttacgcaaaaggcatctgccaaagggctgtctcattcctttggtccttcagtttcatgtgcttcatcatcaacgctataatgggcatcgatctgtccatgcatggtacactaagcattgcagggaggggcgagagggctaactgggcgtgcaaagaggagcccaagtgcatgcgaaacgagtcgactcaattaatatctttgtgcgtttagtcgcgccgactctttctctccccacctcggataccgttaccgacgatcggcatacggcatccggcgtcaaagcatggcggtggacgagcgacagcgttggcaaagatgaggtcgcaaaaatcgagctgacagtcgttatcttcttatctcaattgcttcgagtcctttgattgtcctcaatgccaactccacatgccccccatatttcttgttgttggtgtgtggagggcaatgtggatgaagtaggtgtgtgtgggggatgagaggcatcaacaacaacgaggagaaacaacattggcgttgctgcgtaggcacatgtcgcggtgaagacgcgcagaggttgagtatctcgccgcccgtactagtaaacctagacgaaccaagtagccaagagtgagtcgacagaacaacatagaaacaacaaaaacgactctagagaggtttaaggcaggttcagggaccgaagcatgggaaggtacttgtttgactgtataacatcgtctggttgtagcttctccattcatgcatgttggatgttttgctcgttactggctggcttgaacgtcggggaatacactatgcagaaggttcactgtacgccggcagcaggagaggaaggtgaatctatcggggttgagctttcgtatgactcgcgcctccgtatgaaaatcctggagtctcacaatcagtctaggcgccgagtcaacagccggtgaacacaggtgttggcgtcaaggtaccaggatccgcataaaacataaaaataatagaaacgaaaccccctccccagcgacaagtatactttctgtgcaaagagactatcatcatcatggtcaaacattcctcatgacaatcatcgacacatgggtagggcgtactatagcaggcaaagcaccatgtctagttacgcgacatcgagattgcgttaattgcttcgagaccatgcagcttgcctcgcatgatgcactacatattttttttcctcctgttcttctaaagactgttttgttgcaacgtccattttctgtgttctacaatcacgctgaacggtcgtgggcctccttaatcgcttagaccccccctccttcaacattgtacagaataataaaaataatcttcacgcgcctttcgctgactttttctcgcccgcacggttagcactaagcgatagagaaggaaagtaggctagggcggggtcgtgcgctaacggttgcagcgggatcgaggtccaattaaacgatgtgcgtgtgcctgttgtgtaaatgcgtgtgaagcactagactggcatgggcttgcctaaatgtgcgacagaggggggaagggaacctacaatgatcctcaccaaagcgcgtgcaaatagacaggatgtgccagcacatatgaaatgttgacgtgtctctctttccgcacagaaaaaaataatgctagaagcgagctggagggcacaacgtagctagtctacacacacgtggaggatggtgggggggccatgggtagatcattccaaagtccgtcgagaatgatgtatgcaccttctgtacagacgagccaacaccatttccctccgacgtggagaaggcgtggagaagggaaacattaggtggtcatgattgtatgcatgtccgctcaaacacgcggatagactacttgtgtgtgtgtgtgtgtgtgttttttctcaccgaaaaaggctccgcgacagcacaactgagcacctggacttttttgaattgaacgcgttgactgtctatccatcatgcatgggcggagaagggaggggcgatttgcatgcagatgctggggttaccagagccgacaagcaagaccatggctcgacagcccggcgcgataaatgagaggagggacacagagtttctggacacaggtctgttcgctcttacctcctgacggtgtgggaaaaaaataatcgtcgaacacaagccgtgaatttggagttgcaatcaatgtcgtgttcggcatgcccacctccctcccccctgaaaatctcgctcgagaagtgaattggcttgcgtgagggaagggcactgagtgcgccgtggtgcagtggtcgatgatcaaatgccaaggaggagcacgacagcagcgtacaaagcatgcctgcttgcctattccacagccagtcgccagcacatgagatatacacattgcagcaacaaaaaaacttgctgagaggcgtacaaattggcacgactcggtgcactctaaacccctctccctcctcacacgcatgcgatcctccttcacgcttcaacagccgcgcgatccgagcgcgcgcaaaaaaatcaattatcatgcaggaaccatgccgctcaatgcacgcccgaccgatcgatcgagtgcaatatatgcaactgtacaatgaatgaacgaaaagaaggatgatttgggtatgcaattggaccttcattttttttgtgggggaagtgctgaaagtgtatacatgatccattgatctatagagtctaagaaatactgtacaaaaggaagagttgttgttgttgttgttgtttaaagacgggcctggatggtcttgccctgcttgcccaaggggttggtgaagggcttgatatattgctcatatccctcgacgacctcagtctggttgatgggctcgcgcgtggccatctcagtgtaggcctcatagacctttccgtcaaagcgaccgagcgcactgttaaggtagtagtctgggaacgcaaacgcatcaacaaagcccacagcgttggggcggatcttgtgctccatcacatccatgatcgccttgcccatcatcgagacctgcttggcatcaatgtatcccgacgtcaagaactcgccgggctgcttgtggatctggtgaagcgcaaacaaatccgagagatctgtcagggcctccttggcactctgcgacaacacgggcgcagcaactccctcgggctggggcatatcaccacgaatgcccaagataaagttctggaccaggatcaactggcaatgagccaccgaggcgttgtagatctcgaccaacatcgagttccaggaacgcttctcgacatcgagcgcatgcacaatctcggccaccatgtgggcggcgcggtggccgtacgcagcaatctggatctcggggttgtggaactgagctggggtggtggcagggcacttgaggttggggttgtcaaggtaggtgttgaggtaggccagggtggggttggtgatggcgctggcgctgaacttgcccgagttgcgcttggcaaccaggtcacggaaggacttgaacaggtagcgtccagtctgttgggtgatcatgtagttatcgccctcccaggtgacgttgggtgcgtagtcctggagcataagaggcaggcccgagaaggacgagaaaccgtggccaccgcaggcgcgacggcactcttcgatggaggcagcggccatggtggtagtcaaggacttgagtccagagctggaggcgtgcacatcagccaggagcgaaaagttgcccgaggccatgttcttgatgttgaggtagtacagacgcatcatctccttgctggtgaagtggcaggcatacgcagcggcgatgatggggaacaggcggtactgctgcatggagtagtccaggacaggggtctcgatcacctccttgcccatcttctttggcgagtccttgtcaacgaactggcgacggatggcggagtagcgggtggcgatggtggcagccttggcgaggccgatacgtgcatagccgaccagcgaggcgcggatcaagaccatggtgccgtacgagagcttggagttgggaggcttgacgtactcgccagtaccggccttgatgctcgagtactttgcgaggagagagatgcgaggggcgcggtagtgatcgaaccacatgcagccgttgtcggtggtgttgtatctgcatgcaccaggaatccaatcgagagcacaagaaagaacgatcgagttagcaagatgaccaaacagtgccttctttttgggagtgggctgatggagtgacgccaaaagacatgaacaacttacccaaacttgggaccaatgtctccggccatgactccaggcaaaagagtgtggtcctgcatggagcggatggggacgacgaatgcgtgggggccaaagtccttgccattggtgatcaaacgggccataacgacggcgtggttagcagccttgccgagtcctccgatccaccacttgcaggcggtcaggtaaggggtatggaactcgaactcgtccgtctcgttgatgtacgtggccgtggtctcgatgccctggacgttgcttccgtgtccaatctcggtctgggcgtagcatccgatgatctcgtaccggagggcgggcttgaggaacttttcgtgctgttcgtccgtgccctgcgagacgagcgtgggcatgaacatgccacggtgcagaccaaacggaccaggctcgtcaatgaggatatcggcctgctggaactcttcggcgttccagccctgctcctgcgagagcttgaccagggcatagtccttcttcagggcaccagcaaagcgctccgtgcgaccgaggtagtagcggttggacttgtcgaacgcaggctcgttctcgatcaggcccatcatcttttcctggcgctcgaggtactcctcgccgtagatgtagttggacagatcgtggaccgagaaggtggtcttggagcgctcctgggcgaggagttcggagccctggggccctgaaggagggaggtcagggaagcgaagagcagacatggctgtgtgagtgcttggtgtgtgctggggtgtgtgcttgaaagtggtgatgtcggcggtgatcgatgcaggtgtagcaggtgtagcaggtggctatggtggtacagtgcagggcgtgtgtgtgtgtgtgtgacgaggaacgcaggggcgggcggatgacaaaggtggatgaatgcgatgcaatgaaggagacaacgacgacaaggaagacacggaagaaagagatggaggagagagatgatcaacgaaacaagcgaaaggagaaagaggaaacaaaaaagatgaaaagaaggaaaagtgccgtgggtgtgtcggtggagttatatagacacacccatacacccacactcacccacacagccatgagagaggacacacaccagcccggagcggatggccgagcgtggagacagcgagcgacagggcagttgtgtagtctacagctgatacagtacagtgctggccaaagtaatcgccaggcacggtgtgtgccaggcacactcagatcggacgcacggcagcaaatgacgagcgtttccgactgaggggtgcggggcgtgggcgagcagctcgatctcgcggtggctgctgctgtcatatgaagacccaactgcccaactgtcaacaagcgtggcacacacacacaacggaacgaatttacccaccgccctgcgcttgccgtgcccacttacacgtcgcagccctatcaccgccctctgttcctgcacacacacacacaccggccgatcgatctccgccctgccctcgtgtgccggatctgcacgctgctgctgctgcactgctgcactgctgctgctgcatagtgacagaccccagcccaaatgccctagactgccccatactgtagctgctgatgcatccactgcctcctcgtctgccccctcccccacacaaacacaccattcaacagtgaccctcgccgatgacagaagacaaaaaaaaaaaaaaaagaggttgagctctatgaatgagcggtgacgccgtacagtggggagacagtcttagcactgggcagggaaagccggctccagcggccattggacaaagtgctgtagccgatgcggagcaaccggatctggccctcaaaggctgcgtttatttccccaggccagcccatccctgtgctctggctcctccttctccactgccactgccactgccactctgcccgcgcatccacggcatcatcctcgtagcttcattttcactcccatttccttttctcgtcttcttgatcctcacacagccctcacattccccattgaaaggcacttggcggtagcattgaaatcaaacaagcagaggtgtactttaatcagacaaagctgcactacttctaataatgccagctgcatacccctctgagcattgaaatgaaaaaaaaaagaaaagaaaaaaaaatgaaaaaaaagaggaaagaaaaaaaaaaaaaaaaaaaaacacgctgcttcaacacagaatccctctcaatgcccttcaaaagacatggtcagcatggcctgcttcttggcctcgttggcttggagagagtaccgcagatcaaccggaagagcctcgatcagcagccggatctgatctcggagttgctccttctgcttcgacgtcgccttgatgatactggcctccggtgcaaaccgtcgtcgctgtctctctggactcgactctctcgagtctctcgagtctctctggtcgcgagatcctctcggctgccgctccttttccttttcctgctccttttctctttcccgctctcgttcctcactccagccaaggttcagcgatgacgaggacgacgatcgcgacggtgtcgctgccctcgaagagctggagctgaacgaggacgcattcgaaaactgtcctcggttgtctggagtgcgctgcagtggtggaatagccttggggccaacgctgccatgggtcccatttcctgatagagtgccatgatgggtccgatccaccgcttgaactgaactcagtggcgatgctttgggtctgctgtctgtggcaaggttgggcggaggcgtgatcgtccgcgaatctgtatcgcttccactgtcgctcctagcacttgcgctgccactgccatgatcgccactggtgtacctgcggtgatcctcggccgcaataccgggcaagaatccaccgtactcgtcgctcgagttgtacgacccttctctggacaagcctggccttgtccttggctttggcttgaaaccaagcaagtctccgttgttggcagagctcccgagctcttctctcatcctcacaagaagatccacgagctccacctcattgcgccccttgacccagcccaccacatcgcccaggctcagaatctccaaatagcgtctccggagctcattctgcgctgcgatagtacgtagacgcagccatgttgcaaagttgccgcacttcaaaaagtccttgtaaaagctctggcacgtctctgaattggatttgaatgtggaggtcctgaacgtgattgcaggcggattcttggcgaggaatttgaggaacgtttgttgtttgaagggcgcaatatgcgggaattgagcggtggacgacagcgagctgtttgcaagaaaaaagcacgaagagaaagaaagaaaaatcaattagttttcagcgacttactacagtagtagtcgacaacgactagcaccattccaactcgtcgcaacagcccttacatgtcgctggggaccagcgtcgcaaaatagcggttaagggggaccaagaatttctctgtgagggtcgagaaatgcttccgaaggatattgtccagcaagtatcctagagttcgagatgcgagttgtgagaacacggccggtatgacgccaatccgctcgaccataaagaaatgcaatgccatacctggtgaagatcggttcgctgttgcctcggccagcatcagaagtaaattggtgtccttggcaataacgcttttccgtttgctgacaagaccctgcatagcagtgcaagtaacagagcgtcagcaacaatcagatggactcaagcacgcgataatcttgttcaaatcgagtctcgaagctggcatacctggacaaactctagcgagctcggctttccatgccttgggctgccattaagtgccttcccgatggttccatcgtgcatcaatttgctgttgggccgacggttgacgggtttgccgattttgatgatatgcggccaatgttccagcgtcttgacaaagaaggggtttgtgactccaaggacaatgctactgggcggtgacgacttgttgcagaacgacttgaagtctgcatcgtgaatagtgaaatatgggcgatagtcgccgcaatatggaatctgtagaggccaaccacacggtattatgtcagtgacccaagttgcgacaaaagcaaaagaagcgagccaaaggcggcacaataccgacagcgacgagccatgtgcttacagggttaatgagatcgaccaaagacgccacagattcgctgcagacctcggggcaagtgccaatgagcatgatgggctctgcaagcgtcatcagctcccagcacagccaaagatcgggcaccagatcctgaaagtgcttgtacagtccgccgttcatagggacggatgagaggatgtgtgtatctggctggaaggtggcaatttcaaagggcgctgtctccagaagctgaggttggtgtggtttggcaagttggacctggtataatgtgcccatgaagggcagctccatcagcgagtccgtcacaggcgccctccagctcgcaatgttgtggaatgccgtctcaagcatgggtttgcccacttcgaagtaggctggtcccaggacagagaccatcttggagaagagtccaatgaacggatgctgcgagaggatgacgaccgacttttgaaaatatcctctgcgaatcgaagggtcctgcttctgccgaaaaaatacatatccgtagaggaatccagcgtctgttgttgggcctattagcaaaagtgaaggtgatatcatgtcgagtgagcaactgagccgtcggtagacaacgtacacccacaagcgcagactgtgcgctgtttttcggaatgtgctgtacctgttgctgcccggccagcggtcgtggatcgaatgcgaaagttgaagacagtgtcgccgacatcaaaggtgttggagtcggggaaggacgagaagcagctgcggggggatgacaatgacgacgagtgcttcgaggttaataacgatatcacaccccatcgtcatacggtagacccatgcagagccccccttttttttttgtctcgagacagagcgagggagtcagcatctgcccaactgacgcacgctcggacgcctttctttccctttccctttttttttgtcttgcatgggcaacggtggatgacttacatgttcttgctctcctctagagtaaagtccgagggagggtagacagactcgatggctgcaccgagagaagcggacaaatagaaggacagaaggggaaccgtgtcagcaacacgcagctaagcggggcggcaactcaaaacgacaatggcaagatggaaaaaacactgcaacccatgtctctcgcccgcttcaccgtcgttatcgtccgcctcttgggtctggtccatgcggctgagcaaagactctgcctctttgacgagccacaatgcagcatgggccggtacctccttttgtttctcacccgcggtccctgtgctcttttgtacaaatgtctctggcacaactgctagcgtgtggactcgctttacatggcatgacaatatattttttttaaggtctgagtcggtgacctgtcgagtgcataaatgacaatcaacgcaaccttaaaccaaacagcactccatggacaacagcaagaaccctgatccccaggcctcgcctctccccatgtcctgtggcctatgctgcccatccgctcttgcccgcaaatgccctgtcctgttgtaccatccccatcgtgctttgtcgtgtcggccatggtctcggaacagaaaagaataaagcaaggaaagacactgcctctccatgcatccttgtatcccatgcgctgtaatcctgggtgtgctgcttgcagaaatcgctcttttttgtctgctccttatgcccctcttgttgtgttttctactgatcatctgtccactccagccggcttattccacacggtgcaggggtggaggagaagagaacaataaaaaaaaagagattgatagagcaaacgagatgatgtcccatactgctgtgtttcgcgtagtgaaagagagtgacagagagagacagagagaaagagagagacagaatcagcacaataaacttgccttggcccttttcgagatcaaagttgacgacgcagaagcagaccatccactgcctcagctgctcgatcgcgagcatatccatgatgtcccagctgctgggcctgcgcctgtggctgctgtccagttcgaaatgctctgggatcgcatggatgggtggccgtcgtgcgggggcagcggcgcctgctgcagacgctgtgggctgtgcgggagcagtggtccgatgcggggccgtgtgagacgctgctggcgagggtggggtcgagaggctgctgctattaggtgcgggcgaggtacctctgctggcccgggttttagagacgacgttcgagttggtgcgtcgcagcgaggcagcgccaaagagggccggcaagctctctgtgctgatggagtgcatgttgtagggctgggagagatgctttgtctttgcactggggtcgttcacggcaggcgcgggtgtgttcttgctgcagccgttggggagtgttgcagaggctgtcgagccgggtgcggatgacattgagtgcgggcggggaagagtgaggcagggtgatgaggacaatggacgagattaggcgagattaggcgatagactctgcgtcgtgtgtgtgtaagcgagagagagagaggagggaagagagacacacacacagagagggagagaaagagagagagagggagagacagaaagagagagagagagagaagaagaggtggagaaaggtatcgacagtgaggatggaggaggaggaggaggtcaagggaagaacgcagagggaatgagaggacgagaagagaggtctggagacaaagagatgcagctgggaaataaaacagacaaaaaaataaaaaaaaagcggagaggactggcgagtcaaaagtggaatacataggccccacacgcaggtgggcgatggcctatgcagcgggccatagactgggccacaccggtgcagacgcagccgtcatccaagcgaccgtgcggctgctgctgtccagaggtggaaggcgtcgatggatggacggactgaccaggacaccgatgacaagagtgacacgagtggaggacaaggaggacaaaggcagacagggaatgagacgacgagcggatgcggatcggaccatccgctggttcgtcccccccttcagcacgctgtctccttttgcagcaagggcacactggctggacaggccaacagcgactcgacaacgactccaaggggcagccccgcctttcattctacagcacaccaccatgcagcacaccctcagacacagacacacagacacacgcgcgcaaacacagccaaaggggaggcccgtcctcaccacaacgtaccacgcagggtggggacagctcaaaaggggcgccggcaggagaccaaccaagcggtacagagcgagaactcactcctcagtggcatcccacgcccaacgcgacctgctcaggcgttcgctttctgctctcgtccagggagggctcttgaccgatcggatgacataaaccaaacgccatggccggttgccgcgcaaaacaacattccttgatttgtcctgtcgactgtatgcatctacgagtgcatagtaacgcgcaagacgacagccgttttttttttgagccttgagcctcaaacagagcgacgcatcccgttcacgtaccacagaccaggcccatgcacgtcgctgcccttggaagcaccaaaaaggaagattgaggagcagcccgtcgggtccacagcccgcaccatcgcgacgaggtccttgaacgaaaaaaccacatttcgccgggtgggcatcggcaccatgggcaggctgggcttgcgcaactataaaaaaaagaaggcacccgaaagaagcacggccgtagaccagacgccctgaagaacaaaacgcctttttctccatgaaagaacgacctgggaaccgcgcgatatccacaggaatgtctgtggagcaaaggcttccatgtcggttgcatcctctctctatatatatatcgatcgatcgccctacatacccttgccacctcttgcagtcttcttttctcttccttctctctctctcttctttttttttctctctctctcgctgtctctccgacacacgcacaaggtcatttccctcgacaaaaaaaaagatgaacgtgcttccagggttgtcagacctccagctggagcttctgctgacaccttcgacactcgactccaaaattccctttcttcactacctaccgatcctgcaagagttgttgcagctggtgcagcagttccagaaacaatggcacacacagctcctcgccatcaacccccacatcgcctttccatcccaagtgaccgagcccacaccgcgtctcaggatcaacagcaagattgaaaagctcttgtccttgagcatggctcttgcgtggcggttctgcacaatcacgctggtcctgctgcccggactgccatcctacagagcatccttccacgaggccgtcttgaggccatttaaacgcgaagcggcgcaatacctggcacgcattcagacgtactataaactcggctccttgagatacctagaagcagatctggccttgacattcaacgatccgcaaccaccgccacagccacaggcactgctgttgacgggagacagcaccgaggacagtgtcaagaaggaggcaagcccgcctgtctcctgcggcgagcttatgcaagccgcaaacaggaagccctcacagcctgccccagtctctgcctctgacacacaattgatctcgaacagagctacgaccacccccgctgcaacatcgcagctgcatcagatcgatgccagcaaggcgttctccagcactgattcaaggacgactctcagtgcccttccagcggtcgctaaccccgcccctgcacacgagtcactgcgacatgttcaaccggcgcctcagcactcacctagcgcctcatacgagcacctcgatcgcactcgcaacggacgactcattgccgcaaaagagcgcgccatcctcagtctgcctctgcccgctgtctcttatacccatacagccacatcacttgccctaagcggccccaccgccatcacttcttctgcccgtccttctctctcctcactctctcctcctctaccccatcctcctcgtcggttgacgctacaagaagcaccccgcctccttcccgcagtcgtcattacagcacccacgccctccataccgccctcgacgactgaggtctccacaacctccacacgctgctcaacacgatcccttgccgatggccctacaccctcgaccaacaccagcccagctcggttacctctgtccccgacaagaactctgatgcagcgacgagtgagtgtccagagtctgatccagcgttttgagcactcggttccatctgccgaaacctacagaatggccgccaagtacagggatcgaaggatgtccttgccgcacctgcagcgggcgctcgagaaggcagagacttctgccttgaccccaaggcgcagccatcctggtgagatcaaacactgcatgcttccatgcacgccacaacaaggcattgccttttgcttgcaaatcgtcttctaatttcaaccagcgcttgctatcatcctctagatgcgccttcctcaggatcctctcgtctgcggctcaacgaaacagctgcagaggcagcagcggcggcaccgctcgcatccgcaagtacgtctgaggcaatcctgccgtaccacctgcgcgatccactctctcgtaaaaggagcacgcgggaccacatccgcagcctacccgcctaccaactcagtcgtatcgaagacaaaaagcaccgcctctcgataacaccgtcatccctgtcctcgtcctcgtcctctttcgtctcctcctcgtccttctctcataccaccatgcccagctcctcgtctttggcatccatacgcctccatcaagcgacaggatcaatcctgtctacagacagaggcaacatgagctctgaggaagagaggaacctgaacaagctggcagagacagtcgaccgaggtgtggctagaattgtcgaccgcgtggaatcggatctttcactgtcgcgaatccgacgtgtcgattacctcgatcgatctactgccccttgttcaactctgggtgccgtaagcggctttaaacccatcactggatcctctacaccacagatggcggaaagtgacgcgctggtgatcgcacgcaccgcacatgtctcgaccgcaacgcaagaggtcgtaccaaggcatcaccgcatcgtcagcgacgacaatagcgacaacaataacagctccgccaacaatgccaacaacgcgctctctcgcgttcctgtgcggcacctgcccttcaacgatcctggcagaacgaccgcgcagactctgagtcaaaagaatgctgcttcctcttctcagggaaagatcaagtccttgatctcggtgatgaacaggcgaccccctctttcccagacaggatcagaacgcagtgacgcagtagtcctgtccgccaccaactctctccagctcctgtcaggacccgtatccccatccactctactacctccagccgaaaatcagctagcgtggccacgcaggcaagagtcgcagcgcagccgcagcatgtctttatcaacgacttgtggccaggtccgactccgaacgccctcgagtggaagcgcatccattgaccagcagcctcgcaacggcgacgacactggcgagatcttcagcaatgatcatgaagatgttcaaggcagtcatggcacaagcagtggccacgttgagctgatccgtgtcccgactcagagctccagtgtctcctcatggtcatcccgctttgctcctaagcctgcacctctttgcctctcagggcttgtcacttcaaccgcacaagcggcatcctcaacccactcgggccatggccacgacggcgacacctatagcgagggcgcacttcagtatctcgaactctattcgcctaaaccacgcgtagagagtgacaacgtctccagcgagcgacaagagcctgcgatttgcacagaaatgagtcccgcaagaggatcaggggcgagagagcgtcgccacaccgtgactgacgcatccagcatgacagcgagcagcagccgcagtagttgtagcagcagcctaatgaacacagtcgtcagaagcaactcgcagcacctgagcaacgccagtgacgaaatccgagtcgcacggtcgctctcttggtcaggctccgatgaagttcctgctttcacaaagccgttcaaaccagtcccccagtcgtctgacgaggtccgctcgttatggtcaagcccctccattgcctccacgcgttcgacctcttcccttcgtctggcattccctggcgctgcagcccagtggaatccgaggccacctcaaaagagttttcagtcgtagtgacttttgatcgagcgtctgttgccgtgttttgtttgaatgagcgacctttggttttatataatacaagttttggatccgcgtagtcgtcgttgctttcccgaaatatataccgttgtttttttcatcatcattgacagagtggagaagggtcgtagggacatggtattctgatagagacgtgtcctggagaggtgggtaccgatttgaaagcacatgatacgagaggctctctagttggagccactcttccagaacacgtacgctccgatgccgaccagcatggctccgccagacatggcgagggtcgagggctattcacagagcacgaggggtaaccggaaatcagtcatcatggcccaacgcacaagaaatgagcacaaccatatttctcgcatgctgctgcttacctggttcagttgcaaagagttcttcttgccagccatgaaaataaactgcgtccatgatgtttcgtgcttcgaaaccacgccattgggtcgcttggtggaaccagacgatgtcgttgtcgtcgtggtggtcgtctttgtcgacgtctgtccgtggccgttctgctcctgggtgaccaaagtcgaggtcgtgttggtgggcgaggttggggtcaaggtcgagagtgggtcgtaagcgctgcttttggctgcctctctaagtgccttcagttccttgatcaaagtggcgttctcttccttggacttgctgagatccttcgccatcgctgccttctcaacagtcagctggcggccgtgctcggcttgcgtctccaccgcagattgcaagtctaccacctgcgcctgcagcttgttcacctcggccttcagagagcttatctcctcggatgattcagatgtcgtcgacggcgctgaagcagactgaagtgctcgagcaaggttctcctgatgcttgaggagcagcaactcctgggctagagctgcctcacgagcaacacgctccagattttccttgtgggtcgattccaagacggccagagcggattcttgctcctttcgcaagctttccattgtttgctggtgctcgttgatcaagtcattcatgctgtccttggcgagatcccgctccagcttgacactcgtcagttccgcagaggtctgggtcaggtcgcgtctcagaatttcgtcctcggccaccaagggctcgagcagccttgtcttttgaatgtacgcatcgagctctgcctgtgtctcctcgagcatcttggtcattttggcgagctctatagcatgcgcctttagaatgtacacataagtagggttagattcttgaaaggctcttgggataatgcaatttcgatttagctccagcttgtgccaccattttttttgttgtctttacctgggtattctgctcgatgagctccttgtacttgacagcgttggccacctgaacaagtgcttccgtggcctggggactgccggcctttccatcctccttggccgagacaacaatggccttttccagttcgccgagaccctgcttgaggacaccgaggttggcgtttgtttcctgcgagcgagtgagctcgttctggagacgggagatgatgaggtcaatgttggcgctctgtcctccttgcgccgtagaggtgctggactttgagctgggtcccgtgccggtgggcgaggaagccttggctttggcgtacgagtcctgaggcgatcctcctggcgttggataggacatgcgggagatgtagatcttgcacgcgaccttttcatggagcactagcgttcagcaagacgggcaggcctgtcagtttcatcatgtcatgggtgcacgtgtgcctttttttttttttttctctccgtggtgtaaaggtgtgtctgtcacttacatgctccgttctcgtccataatgtcaataccaaactcaagattgtcgttctggttgaggacaaagggctcgctctcgacactttcgggcgaaagtcgctttccgttcaagaacgtgccgttgctcgacttgagatcgcgcaggaagacctaggaagcatgaaacaagggtcatcatgagttaccttttttttttttatctcgtgagggttgttttctgaagcattgaattgtgtgagcatgtggacataccttgccattctcggaccagacttcagcatggactcgactgagcactttggaatcaaagtagccattggatggggcgggggcggtggcgacgccggtctggcgaccgattttgatcctggtctggtcctgcagatcgagggactttggcgcaaagttgttgttgatgggctcgaggacgaggatggggtttgcgggggtatcggaggcggacgacccgttcatggtggagtactttgagtctgcgggtggcgaggacgagacagaggtggcagagagggtgggcgaggctagagagagagcagcggtggcagaggcggtcgagacactggggagcgcgtgtcgcttgggcaggatgccggatgagaactggagcagattgtgcacaggctgggtgattgtcgacgtggagctgacagagggagctggatggatggagagtgtgaaggaagagacggcgaggagacggagacggagacagggacagagagaggagacaagaggcgtacgtgtgagagacagagcgagagagggcagagagagagagagggcagagagagagagagcgagagagagtgatggagaaacaaagacaaaagaaaaaaaaaggagggagagagaccgatatgcaaataccagcacgatgcgatgcagctaccggccgagtccaacagatatttcatcagacgggtctgcacacgcatcacacacatcacacacatcacacacatccatcacacgccccgcccatcttgtacttcgccagcgagcagggtttatggacgctccagtcccctccaaaaccacagagggcactcacttctttttttgctcgatctcctcggacccatccacaacatacacacacacacacaacaacacgttacagaaataaaaatacaggcccagcccataggaaggggacgagagaagcgcgcgcaacaacgaagcgaggggaggggcaagaagggcgggaagcaaatcgagagcatcttttttttttgagagcatttttagagacaggcagtacttacttctggacttgttacgataagggaaggcagggtagtaggtcgaagatgtcgctgcgggctgatggctgctgctgccagcaggagtggcagtgggtgtagtcgtggtagtggtgctcgtgctggtgctgttggtataggtgccgttgagattctggttcaacgccgaggaggaggacgcggttgaggaaaggactgcagtggatgagcctgtggcggtggcagcagcagtggtggtagagggcgcgctcaagaggccgttgaggctgttgatgcttgagacactggcaacgctgctgctgctggccctggatcgcgtgagcgatgatggcctcttttcgtctgggatcggggggctgttgcggcgagtggtcatattgtcacagctggtctcacgagaaggagagggaatggcgaatggagaggatggaggaatctggtgggaggatgaggccaagtccgagaacagagccaagggataagaagcagggaagcaaggggggaggagcggggagcaagagacagggctagggggcacgagcgaggaaatgcctggcaggatagcgcgtgggagagcgaggcgcgagagcagcgagacgaggaaagcgggtgaggcggggtagggaagcagaaagagagagtaagagcgagagagagcgagaggcggagagcgagatacaaggaggagaggcggcgaagagaagaagggtgatgaagagggacgaagaaggactgacagatggagagactgagcgagagagagaaagaagaagagaaaggaagagaacgaacagaaagagaggcgaaatgaagcggattagtgtgcctttatgcacaatggcctgggccagtgtgggtgtgcataaaatacagtcgacattggcatcttacgtgggcgggctactctattcctgtgtgagttgtagttgagttagtgtgaggtgagttgaatgaaattcaaacacacacacacacacacacaggtgggctacacaagctgcagcacacaggcagttgcaacagatttgaatgaaaatgcgcttgttcagcaaagcagaaaaacaatgtaacaatgcactgccctgccctgatcctgtgcttacctatgcagacagacggctgcttgcgacctttggtccttctcattctctctcttctcttctcttctcttctcttctctgccgctctctcgtctgcaccttgcacactctgctgtcaaagggacacacactgacacacactgacactctgcaatatactccctcttggtctcggatcattactactctcacgcgtaaaagtgacaagagtagtcctgcgtcggatgggtgtcaggttgcttatttgtatatagactactgtagtctctattcagcatgcgctctaccatcaccactcatgagcccactccaaatatccagtcggccgcaatacagccatcgtgttgctacttcatcgctttgctcagatgaagcaagggtacagtacgccgcgaaaacggtctccttcctgctcaggcacgccaccaaaaaaaaaaataaaaaaaaaaaaaatccaatggtaaggaagcagagcatggcgcccagtggcgatgcaagccaccaagaaacgagcagtcccatgtctctttttttttaatgttcggtcactagagggctgcccgtggactatgccacgggtgtggatgttgtggtggtggtggcggtggtggtagtggtagtggtgggtggaagtgagggggagtggtggtgggattgtggaatatttttcttttattttttttgattggatattttcccccttcccctcccctcgatttcatcgcttctcactgtctcactgtgatcccaagagccaccgcttcttggagggctatgcgcgcttcgcgcacacagataccaggggggattgccacgcgcttcgcgcatctctgcggccgcatgcggcctccgaggctcgctggcgctcgcgtatggttcgggctccgccctcacgtgatatctttgctaactgctaatcgccataaatggcgattattttgctcaattcttttaataatatagaggatttgtcttgcgacgacctgttctccgtcccacccttgtttctctccatccgcactctgtcggttttctcgttcttgcattccctcttgtttgccaccaactggatcattctcttcatcaaccacttcctcatcctcttcctcttcctcttcctcttcctcttcctcatcctcttcctcatcctcttcctcatcctcttcctcatcctcatcctcatcctcttcctcatcgtcttccgtctctccctcgtcctctgtcctcctcttccgtcctgtcctcgtttttctcaagttctccttgttcccgttgcccttcccggtgcttccttgcggccttgcacgcactgttcttgcgcatccccagcctgtgtttccttatcgctccttgcaccttgccctgaagagagagaggctcgtcgtccttctcatggctgctgctcccacagccggcgcttctcctcccccttctcgttcttgtccttcttgttttccttgtcattcttcttcttcttcatcttcctcctgctctccttgctactgcgcttcgtgctcctcttgctctcgcccctgttcgccttgaccctgtcctgactcctcctcctgagccctttggctagtcagcccactcgacgtcatggtctccagagccatgcgccagatcgtgctcatgggcatcatctgctttggcaccatcggaatgttcaacgcaatgtcctccatcggcaacgcaggcagacactcgcccaccgctcaaaacctcgccatcacctcctcctccatcgcctacatcattggatttctcctcgctggcggcacccacaatatgatcggcccccgactctgtgtcgtctttggcggaatcacctttgtgctctatgctggatccatgatgctcgctcaggacaatgacagctctgtgtacccgcctctggccggcatcctgctcggcctgggtgcaggcctgatttgggtcacccagggagccatgatgatgtcgtacccgaccgaggacaacaagggcaaatacatcgcctgcttctttgccatcttcaacctcggagccgtcctgggatcggttctgccgctggccttgaacagccgtgagaacatggaccccgatgacgtctcgtccaacacttacatcgtctacatggtcatcatgggcgtctccactctcctggctgtctttctcgcccgcccatccaccatcgtacgcgacaatggcgagccagtgaccgtggccaagtttgcaggactcaaggccgagggcatggccatcctctcggtcttttgcgactggcgcatgctgctcctcatcccggcctttttcttctccaacttctcttacacttaccagttcaacgactttaacggctttaacttcaacatccggacccgctctctcaattcgctcatcttttgggtcgcgcagatcattggcgcactggtcatcggatacctcctggacaggatccctgtgaagagaccgaaacgagccaagctggggctcctcgtcatcgcactcttgtttatggcaacgtggatcgcagcgctgatgatgcagctcaaacacaagtgggagcgcaaggctctgcagagaaaggagttgatcgattatgggcacggaaccaactacacaggactcttggccatctacgccatgtttggcttttgcgacgcagcctttgcggtttattgcttctggctcatgggcgcactctccaacaaacacgacgagctctccagatatgcaggattcttcaagtcgatccagtcgctcgggagcgcagtggccgcaccgttggatttggcacagaccccactgctcgcctatctcatcactaactggatcttgtgtgccatctccatcgccaccatgtttctcgtcaccagaaccatctccgacaccaccatcgacgacgaggacgaggacggttatgaagaagattacgagtatgacgaccaggaactggaggcaggggagccctcgtcgtgtggcacgtcggatgtccacgatcaaaatgagacacgcccacaggatcaaggagtacgcgagcaatccaactctttcgagggggacatgagcactatttgtgccaccagcgatgtcggaacagcagctctcgatgcgcgatcgagcgggcggccctcggcgcattggcgaaacagcagcaaggcctctggccatcaggacgattaccaggacccaggtgctcagcactcgaggtcatcggacaacagaggcaataggctggcagcgggcgaccagagtcctgccgccacccatctttccgcgtctgacgagacgacattcccatcccgaacgtatcagcagcaccatcaacagccactggaccggaatgcatatcttctcgcgggtatgccggccatgactgaggtgcagcacagacccatgtccggtgtaggatccgcgtattgggccgatcaaccactttcaagagcaggatcatcacacagctcattcttccctcagttccaaacctcaataccaaactcatccgcatccgcccccgcaccctcctcatcctcggccggaactacgacacagtacctaacgcccatgtatatgcagggattcagtccatcaacacaaccgccaccaccgagtttggtcatctctgacgattcttctttgcctgtaccgctcttcacttatccgcctgcccacctgtatcttcacccaccatgggctgaagaaagttctgtccacggggctccagagccggaggggcgtggagaggcggaaggtggccacaaccctgccgcgattgggtatctcatgccacacgagccattggacgaggcgctgcgccgagcgagtagcggaagctcgacgcggtatgacgatgaccaggacatggattcgatcgacacccattccatctcgtccatgtcctctggacacgactctatcccagagatgaccgagatgacggacatcccaaggccccgagatacctgataggcacctcatattagcatccccttcaacaacccatttaaacccattgtactatagtaaacctgttaaaccctacctctctgcgttttgttcatgtattttttttttttttttttaatggttcagcgtgcttgatgtcttgttaaaccgctttcaagccagagcgcgttctaaaatcatcataaaactctatcatctctggtgtaatcctccgagtcatgcccgagagtgcctgctcaaagtgcctcctggccacacaagcaatctccagactctcttccatggccttcatagcagcctcctggcacagggcaacgacctcggcacccgagcagccatctgtctgctgggccagcatctccacgtccacgtccgggtcacaggccatttttttcgagtggatctgcagcctcaggatctccctgcgcgaggcgaggtctggcggcgacacataaaggatgcggtcgattcgtccgggtcgcatcagcgctgggtccatgatatcgggtcgattggtcgctgctaccacagtgacatttacgagcggttcaatgccatccagctcattcaaaagttgcgatagcacacgatctgccaccgaggatcctccatcgtctccaccaccacgcttcacggtcaaggcatcaatctcgtcctgggggttcgttaaagatatttggttaatttgtgcatgaaatgaagaaaaaaaaaagatatgcatctgaccatcgcctgaggatccgaaaaaaagtcttacaaaaaatacgatcgagggtgatgcggcccttgccttgcggaagacctcgcggacagccttttcggattcacccacccacttgctgaacagctacgaggatatgcgtgggagaagagaacggccgttagaagcccgcttcagaagaacacatcatttagcatacttcagtccccataggacgagagcaaaactgcacactcatcgatcgtcagctcccttacctcagggcccttgactgcaatgaagttcagtcctgcttgtgtggcgagcgctttggccatgagcgttttactgcatccaggaggcccgtacaaaaggatgcccttgggcggccgaatacccatgcggatgaaggcttctgggtgctgagagaggaatcaatcaggtggttaatcttagcaccgctcacagtacctcggttcctctcagaaaaaaaaatcatccacgaacctgcaatggccactcgacagactctttcagcttttgcttgatctcctcctgcccaccaatgtcgctccaaagaaccttgggcacctcgatcatgatctctcgcattgcactaggctttacgtccgtcatggcaagtcgcatatcctctgcagagaccttcaggtcatcctcgttgtccagcattgtccttgcactcgtagacggcgaaagggtcatagcctcaaacgagtcttgcagatcagattcgtgtgtccgctgtttgcccatgacacggttaatggtcttgagtccagcctcgcggcagactgccgccagatccgcaccaacgtagccgtgtgatattgatgcaaggtggtccacttgggcaggtgttaaagtgttgggtatctttcttagaagggctgtaaaaatttctgctctggcctgtgagttggggatgccgatttcaatctctcgatcgaaccgtcctggccgccggagcgcctcatccaaggcgttcggtctgttggtggcacccataactacgatcctgggcgtgctgtttgctattgcaccgcttgcttctgcagtcgaggaagaagaggaaggtgccttcttttctgacactccatccatcaacgtcagcaaagtcgccacgacacgcttctccatttcacttgcggcctgtcatgtatggtacggtaggtgtcagtaccttcactgacatgcagagaaaatgccatatccttgcacagatcatcctatgacccttacctcatcacgtttcggacacaaggcatcaatctcgtcaataaaaatgatggacggggagttgtccgccgccagctcgaatatggccctcagctaaacgacaaggaacgccatggttcgtgaatttgttgttagatctcaggctaatggttcaggtgatgggcatatctgttctactagacacaacagatgtgcgtaccttggcttctgtttcgccataaaacttgctaatgatctcgggtccgttgatcactgtcaaaaacgctcctgtcgctgctgccactgtccttgcgatcagcgtcttgcctgttcctggaggtccatacagcagaacgccctttggcggccgcaatcctagaataagacattgatgattagccagcggcatagtttgatctactggaatggtccttgctctgtttttcggataggtcgcttaccgaactgagtaaacatttgtgggttgtgcagagggatctcgaccatctcgcgaacagttttgatctgagcggcgagacctcctatttgatcgtaagctgtgctggttgccaatgaactctgtgatgcgtccgtgtcctttgcgcccgcctcgtcaaaaatctctttgtggatgacctcctgagagggagtgaaaggcaacactttgatgacagtgtcctgaccaatagcaaacactgatcggccatcctgttcatggcgatccagcacaatacttgcgaccttgaacctctgcggtttgccattgtacgggaattcgataaagttgtccttgatcacaaacttgatctcgtctatacatatcaaaaaaaaaaaaaaaaaaaaaaaacgggacggcgaggaataagcatttgactccagacgatgtctgaaaagatcaaagatcaacaacagcgtgtctccaagagtactcactcataatctcctttgtgaatagcgtaaacaagaggttggagacgaacggtatgggatgaagtgctgccaaggatatctgtgaagcttcatggatggtcgtctctatgagtgaaagctcgaccggctcgcccacggccacgttggcattcaggcgcgacacgctgctcagttggatgtctatcgtgtcaacaggtaggggatagaggaggctgataaggtgagcctgagcacatgcaggtcaactatgcggagcgggcatcattgtcctcgtgcatccttcggttgcatgccacatacgattttcagggacagtgattgagggccaagcgatagcgacagatccctatggttgttgttaaaggatacgagggcgaatattgttggccatcgttttacggtgactagcacagagactaggaaatggtcgactgtagccacctggaatcgcaaggtcatgtgtgcatcaatgggcgtgcacctaggtcgatcgcaaacttacgggcgagtgctgtgtgtcctgcgatggatctggctggttcagcttgttgcgaatcagaatgtgatctcctgcgccgagtctgaggtgccgcatggtgttgacattgagaaaggctctcctgacggcgcgcacattccgtgccgacggagactgctgcgcgagaagttgcatggatagcgtgtctgtttatggacagtctatgtgtcttcctggtcctctcttcctgtccgttgaaggcctgcctgtgcaatgctcgcggggctgtgcgtgtcgttgtcaagaagtcaagaacaacagtgaaaaagagactagtctgcgtttgagcaacaaatccatgtcagttgcagtcacagtgtcgaatttactcctttaattcatatcagaaaaaagagaaaaaaaaaaaaaaaaaaagatcgcgctgctttctctcttgatgcatcaaagtgatggagtaaacagctcgggagccatgaagtgcgttggtcaacaggacgcacgcaaatcgcgtcattccaagacctctaagggctgggaagcgactcgatcaactttgctgtaagtcgctcgtcaatcatcttgatgcgctcgttgtacagatgcttgtacgcgttcttgatcgttacctcggacacaccacacacaacactgatgtcgcgcgtggttcggagctggctgtacatgttggagctcatgtagatacaggccgcagcgatcgagacgggcgatttgcctgccagcgttccaatctccttggccttctttgtcagatccacagccgtcttttggacttccatgggcaacgtgaggttggagcagaagcgagacatcaaatcctccgaggtcatagtctgcaccttggtctcctgaaaggcatcgttcaacaccttgaagcagcgaccaatctccttcttgggcacctgtgtcagagtgcaaatctccttgaacgtacgaggcacaccctcctgacgacaagcaataaagatgcacgctgcaataatgctctcgttgggcttgcccctgagcaacttttcatcttccacacgcttgaacagctgcttggcgatgtcggctgtcgaccatcaagtcacaagaacgcagatcaaaacaggtcaactccaactcagcttttcttttttgttttcactctcactctcactctctgtgtttgactctggacgcaaatgggctataagcaatgcaaggcacagtctttgtgtcacctaccaattagtttgggtagaccaatggcctcggacatggctgaaatatccttgtaagcctgcagcaagttacgctcgcccttgactgctgtgactctgccatgcgtcctattgagctcccgtgcagcgccagagccaccgtcgcgctgggagatgaccgtgtccagctgagggccattgagcaaggggttggcggcagatccgacacgggacgggtcatcgccctcgtcgtttgcaaacgttcgccattcagaccgcgtgtccacgatcctgtcaccaagaacgaggccgcagtctgcacacaccagatcgccagacgagaactcttccgagatattgggcggaacgatcttgcaatctgcaaacgtgtgaaacggcatttttagtataaactgcacacgtgatagcctctcctctttcaatttgggatggctcacttttcttttctccgttctttctctctcttcattcctccccgcccctactccaccactctcagacaccagttgattatcaatcattttcgaactgaccagttactcacctggacacatcagcttgacattaaggtcgacgaccttttgtacgggagcagcaaccgtcattgttgtcattgcttgggtaagggtaaaaaaagaaaagagagagaaaaaaaaaagtgtagtggaaatgcgggagcgagccaaaggggtcggatgggcgaaggtgaagcgacagtgaagaggtcgactgctgcaagtatatagcagggtgatggctgtggccaaagggagggggggtggaggtgtggttgatttcttaatctctttgcggggtgtggtctcccttagtagacgcaatcttctctgacttgccgtttgcctgacagagggcaaaagaacaaacccttgatgcactcgatcgtgttttatatgtttgtatcaagcagcagatatacaaatagaacagagacagagagagaatgagaagagagcctcgacgacagggcttgaccagatgcaacagagatgaatctttgacgagcgacaaagagagaaaagaagaacaatgaattcaaaaaaaatgcgaagcagttttattggtgcgtgtgttaacagtaccatctagttggcgtccggtgacgaaagtcgggggggggttggggggggggggggaaggggagggatggaagctcttactcctccagtgacagtgagaggctgtcgatgtgctttttgagcatcttcagcgcacccttgctgatactcttcatgacagggctggacgaggcatcttgttcactattactgccgctgccctcgccttcgtcttcaccatctgggtccgagttggcctcggagcgggctatcagctccagcccttcaatgacaatctgttcgagcttgccttggttaaagtaaaagtgtcgcacttccttttgaaacggagttggcgggttgttcaggatagtttgaacagcctagagttgaaaagggggtagaaagcaggtgtcagagccgatggtgcaaccttagagccggtcagcttgcattgcgtcggtcgtctttgtacctttaaggagagaaggtagaccttctcgttatacaattccgagtttctggcggcttctattgttccaacaaacttttcgaacctaagagatggagcgaccgtccttatcattagtctaggtactcgacgcatacaggtggtcatgagcagtactgtaggccgccggaaaggacttaccctgcttcattataatatggttcaggcacgagtacgagcccttgcagtgagattaagagctaagggaatgaaaggtaacacaacgttagcggtctttagcttcaagcgcctagaccaaaccatcctcagagctctctttcttacctgtaggatactggagctcggcgtccatgtttccgtttggtctttgccatgccacgtattcaaaagactaagacagacgttaccgtctgagcaaagaacaaagagtgtgttcatcagtataccgcagggcgagaggcaatacagcttgcgtacaagcaaacagtgactactgtaccttcatagaggttggggttaatccttccaataccgccagtccatgaatgaaagaaggcgacaggtggctattgcaataggcaaactgatggttagcgaacgtatgatgaatggtgatgtgtcaagatctggagagtacactttttagagacttacctggctaggaaactggctgggcagcataaagtcaaacaggaacagggcgtttctgtagggggtatggtcgggtccttggatcaagactcgcagcaggtccattcgatcctcgaatgcacggacgcgaattccttccggcaatgaagacgacaagatggagtgctccttgacgactcgcttgatccaggccttgtcgctgtgaggggcaatgggatgtctctgtaagaagtggtggtcctcaggtgtagcttcggccactagaaagctcttccaatcctcatgttccaaaactggtttccgctgtgagtgactcgtgccttggtctggtgtcgctacgtcctcgggctcagaaagtgggtcgcgcattcgactctctggggtgctgtcaaccacaactttctccggccctggctggtccccgttgacgtttggtaatggcggggtgtcctggtggtcgccgtcgcttgcattgccttcgctttctaccttgtctattctcagcgccgaaacgtcctcctctacatcgctcattgagtcgtcctcggcccctgaatcggtttcccagctgtcgtccgacgagacctcctccccatcctcctggtcaaagtcgtactcttcaaactcgccctcgacctcacttgcgccgtcagcctcatcgtcgtcatcgtcgtcgtcctcgaccaccattattctgcccacggggacttcctccgtggtcccgtccatgaagcgtacgagcactgagggccgatcccgatagacctcccagatttggccgatccaattaagccgtgttcgaatggtctcaatgtcccgttcaaggtctgtaaaagaggcaagtgtctcttccgaaacggcaggggcgagggggtcaccgcggtcaatcagccagtacatgctcgtctgtgccattttgttcgactccgacaggtagcgatccagtgcctcgactccttcgactccgtagctctccagcaggacggccccacgccgctcaatcattttgtgattgaacacctcagatccacgatgctgcttttggagctcgttgcaaatctcattgcctcgagcaacgagcgcaaggacgtcgtccacacttggagcccttggtgcaatgtcggacgatggagactgttcacgctctctgctcacgatgaccttgtctcccatcctgaacttgaggtccgggtgtgacatgatctcgtagagtgagcactcctcagtgtcctgttccagcccttggtcgcgctcttcactgaaccacttgacgagtgttgtccgctccttggcgttcacggactgtacaatgccaagcatatcggactttttcctgtcaaagccaactcctcctggttcattcgtgagcacttcgccttccttcagcaggacgtagtctgagggccaaacgtcttgatcatcaatgttcagatatggcacaagctcggtcgaatacacgtcggtagaaacagaaagatcctgccactgtactgtcactcgcgtctttgtcccaatgactctctgttttgtttcgcatagatagaaaaggttagagtggtgccggtcgaggcaactatcactaaaggacatagtgacatctgggttttaccatctcttctgtcgcaaagctcaagtcatgatcgtgtgtcttttctgggcattgcagtcttgtcgttttgcttttcagataagggcagtattcctgaagacccaaagctagtagagtgaagcatcgacgaatacagaaaaggctttctgttagaaaacatgattgcttcttcaagcgtttggacgagagctgtcaagactttccatcacaagacctttcccatcaaacttcaggcgcgttacctctcaaggtatccgggtcgaccactttgactctgtccatgagttcgtaggtacagtgctgctccacgctcttgtacacgacaatgctttcgaaatcatccaaaattcttggcggaggcgcgactcctggagtttggtcaagtgccagtgggttgaacgagagccagttgactgtgatggccacgacctctgtccgcatgacatgtccagacttctgtcccgagtaggtcccgacgagatactttgcgttcttgaaaatacgtgatggtccacagacagcctaaccatgattcaaagtgccaatagggtccgacgtcagtaaagaatgataacaccatctcctgcttttacaggtttgaaaaatacatggagcttgaagcttacatgtccaggcgcaaggtggtccggaaagaagcacgactggtcgtgtatctgatctcgaaggtcaaggtcgtccgagtttttgattacgcatacactagtgttgtcgctcagcaatacggtcacctcgtcttccacctataaagcacacagattacggattagagtcgtcaggttgcattgaatcacctcttttttcttctgacaatcgttttgacaggcgttgcttacctcttcgatgacgcccaaccagccgtcgtagatgatgtgattgttgactgcaaactgctgtacaaagtccacatgctgtgcatcgatcccaggtaatttggtcctgggtggacaaacccgttccaggtctagctccaccttgactccaatcactgatccggacatgatgtcgttcggagacttcttgaccacatctccgtggctgaaagagcggtctgcgacaacgagatcctcctcgagcagggtctgaggcgcagagccatcgcaccagtggacaacaacttgctgaagaccgagctaaacacgtcgatgccactcacgttagttgaaagacaagagcctacgttgcaacctaagttgcaagtcaagcgcaaacgacctagcacccacttacaggccctgaggaagcttcgtcctcggaatcgctttcgcccgactcaaagtcatgccaagtcctgacgaccaggccgaggcggtctgggttgtcctttgagtgcactgcatcttccaagaagatctggaggatagggaggggtcaggtcgggtcggttggggttgatgcggaaggagcggagaagggtgggtattagcgaggctgacgggatgaacgtgggccgcagcaggctgaggagggatgggactgcaagaggaggcgcctaccttggcggtgatgagggccttggccatgggcgagctgtggggcgatggatatgcagcaggagaaggtgagcgggacgacgacgacgaatgaagacggacagacagcagtagagcgggatgtgtgcagagggtatagaatgcagcgttggcagaggcggtgaagacaagagcgagtgagagaagagtaacaagaagcaagggaccgatgagttggatcacagccactgagagagctctttttttttcttgcttgcaaacagtcgaacctcctgcaccctgcattcgctccttctgttcacaaatcacaacccatccatcactctcgcccatgtcctccagcaaccaggccccccatatgcgtgtcattctagggtaagcgcgactcggaaacagtgtcctctgctcaacgcctcactctgacaatcaccccgcataatcctcctcactgttagttgcatgacctttggccccgaaggaggaggcgcgcgcgtcaagaccaacgaggaggccaccgagatcatcagcaccttccgccagtacggccaccacgcgctcgataccgccaggatctacaccgacggcaacacggaaaagatgatgggcgagctcgacctcgcaggacttaccgtcgacaccaaggtctttcctttgcagctgggcggcctgcaggccgacaacgtcaagcgctcgctggaagaatcgtgtgctgcgctcagaaccaacaaggtccacgtcttttacctccatgccccggattacgccacacccatcgaagagaccctcaaggccgtcaatgacctttacgagcaaggcaagtttgaggtctttgggctgtccaactaccccgcttacgtagtggcccagatctactacctctgcaagatcaacggatacgtgctcccgacggtgtaccagggaatgtataatgcgttgacaaggcacatcgagcccgagctgtttgcctgtctggaagaactcggaatccgcttccacgcctacaatcccctctgcggcggagtgttgacgggcgcatacacgtaccagggccaggtcgagcaaggatcacgttttgatccaaacgcaaagcaaggtgccaggtaagaagtcgatgtaacttcgattgccagcatgaagaatccgtcatctcactcttgttacataaacgaaattagataccgcgatcggtactggaagaaggaatactttgacgctgtggatgtgctcaagcaagtctgcgagcctcatggactggatctggtgcaggtcgcgtttgactggctgcagtttcactccaaaatgaatgcagaccggggcgatggtatgtgcgagagtccattggttgctttgcgtctccacaattgcacatctgcactttcaatggtttttgttgacaccttcattctcttgggtgaatcctgataggtattatcattggcgcttcgtcgttgaagcatacagtccagaatctggaggcacttcagaagggtcgatctcttccgaaagatgtgctggaggcgcttgatcggtgctgggatatcactcgggagagctcgccctcttatttcaggaccaaagaccagatgatgggcgcgagataacaggcccgtgttatacacctcgtcgacatacccatgcttcacggattaaactatttgacaaaacgcgggtgcgaaacttgctccgttctaggctttaatgatttctacaacttggcaggctcggaccgtctgggggaatcaaatgaggatggctgcgcttccaatcgacttgctcgcgtgttgaccatgctaatgagaaaagcgcggtagcgccgaggcggtcgtcagtgttcttgagctcattcggaagcagcggtcaacctgccatgggcaatcgcacgagaaatatgaaccttacctcaggtacgcattccatgcaattccaacgacgctgacaaagggtaggcgtagctgtagcggcatcacgctagaaagaagaatgcaaaccaggtcagaaaatgtaatagactcacaatgtcaaagtactggtagctcgtccataggtggatgtgtccgtacccaaagttgacgagctgcaccaagggccagacggcatagtttgccctgagtgtcgagaggtatgtctgttcagaaaatagcaggcaaagagagaagaaaacgtcagatcggtgatcatgactcctttggcaccaggtcctgtatggacaatgataggtaacctataacttgcattgttcaatttttctttgatctgctgtgtgccaccaccctccagtacagtgaggccagagaacaagagtagcaggccgatgggagcaaagagaatctggtctgcacccatgcgtttgattgctggcgccatggtttgcaacaaccgagggcggagggttgaattcgaggcagaggctgacatcttgagcggaaagtttttatccagaacactataccaggtgtggatcaccggtgcgaccgagaagttgtacagcatgaagcggcccattctagggagatccagtggtgggggttgtgatggtgacggcgcgaatggctgtgggtctggctcgtggagtgtctgtccgatatcaacggcgagctccttagcatcctctttgactgtctcctttgcgtcttgaagcacgcctgttgttgaggctagtggtatcggttctggagtcagcggcgctggggcgaggtatttttgggtgagtgtgtccgagataccagcgaggagcgcattagtggtgcagatggtgaggatggggcgggcctggtactggcggttgtagaaggcgtaggctggtttaaggatggatgccatcgtgtgctggtgcgagtgccgcctgtgatgccgtcgttctaaggtgagaaagggcgagccaggtacgttcagaggagagagagagtgagagacgagagagggtgtgaggtgtgtgtgtgtgtgtggtggtgtggtggtgtgtgtgtgtgagaaatgcccaatgacgatggttaggtacccggtgtcgctgcggtattgtggctcgtcgtacacgcgctgataggaccagctcggcgtgtcgtgtttggagccgtgcgaacccctgaaacccgagaatcgagaagcaactcttgctacaagagaatcgacaacagcgtaaagggcccttgcacatctcaagttccttggttccttgctgtcaacagtatgcaagcagaggcgaatggcttgaccacacctgaatcgtggacgctgttgcatgtgttcgattcattgcagagcaagacatgatgcgcgctttctcatcaaggtccgtcatggcagtataggttgcgaagcgttctcgtcatatatatcacttgcactgcagaatggcctctgcaggtgaaccaaagcgaagcagcgagacggtgcatggagttgcaacatggtgcacagcagtgatgctgagttgaggtgcagcctcaaaggcgaaagactgcagattttttttcctaggcgtgcgagacattttaagttctgttttcgctcagggcacaaatgtatccgacatcaactccgttggcagctcgtattagtaccgcggcgccatttctcgcctccatctctacgatattctccagtctggtctttcctgatatttcctcctgaagaccaacgctctgagaatacacggcacaatcccgtaccataagtctctcatatctggtacatgactgtagtcaagggtaataaattttgcgtgcgggcgtgccttctagtaaagttggcacagcgaggtgtagattccctcatatcgccgctccatacaatccatattgcaatcatctcattcatttgatcgagctcacacctgtcttctcaaatttctccagactgtgattcatggaatatgcttctctatgtatggtatgcatagtgctaacgtgtggtcttctcgtagtgcgaatacagtagtcaagacgcttgatctgaacttcttgcgtttaaatgctctacaactgtgtgctacaaacttggggtgctatctgaaaatgaggtgggctgtgcgttttaagatctagcaagaacgcgacttgaagcacgctttcgagctcggctgaagagtaaggattcagcttagccccgcagtcgcatggaactcggagggttggtcaagcggattgaccaggagtggaaaatcaggcatcgggaatttccatgatgcgatctgctaacaaccggcaaagtgggcaatgtatcttgtgcatataatgcggccttaaacggtgccgcggtaggctcacgcacaaattactggattagaaaaccgacgcatcagatctgaaggattggaccagctatggttgaacatcgcggattggagttgctgcaaaaaggttgtcgcgggctggagttaccatgatgcataagacaaatcctaaaatgagcagctcatacctggacaagattacgaaacacgcgttccttagaagatgcaggcgacgaagcaagtgttactttttcatcgcagaaaattttagtctttcagaatcttatgaaggctggtggcacaagcaatcggggggtttttttttttacatctcagatgagccggaatgcggggtcagctgctgccatgccatgcgacagaagaaacccttgaagatgacttatctcaggtacatctcgcagctgtgggctacggtccttttgtgggtccattacatgctttctccgcataaaaacattgcagcgcactctctcgaagaaattttcagaggcccttgcttatgctttaaggttaggcttatttgtttgttcgttgccgcatgtcaccagcaatctctcgcttgtttcctaggaagcgcgtgtttgttgtgccagccgagtccttgataagcactttctcacaaacaactcagaggtctggtgagctatcagcctgattgcaacacatgcatagatagggcgtactgaattgtgcatgcacagcttgccaccctctagtttgtggagaaactctggtccccattcacgcatcttcatcgcaaggactctcacacctcgttcctcgttgaggacaaggtaaactgcagagaacgtaacatgcattgactgctataagcacatacgtgttgccacaaagatagtctctgttgaagaagagttatgatatcttggccaccttggcgtgggcatcatgtgtgataatagtcaggtctatagtcatgcatccatccaattcgtcagtctctacgtacaaggaggatagctcgaacagcatgtattgctgatagttcaagcagatcagtttggcagatgaagtctctgttttggtctctgtgagggacccatggctcttaaaaaaaagggtgctgaaagatggcacaatgaacggtccagactgaaaagggcatacctatatgcatatggaagctttgatcgtctaacgtgcatacaacgttattgcccattgactactgagtctctccctcgtcaaggtcgtatcttcgaggcatcctcaaaattcctttgtttatttgttgaccgtccaaagtgcgcgccttacgaaagtagcgcttgcttcaagtgttgatgaccacagagaatgttcatcaactcgctcacgatgtttataagtcgtgtctaaacggaccttgaccactgttgcctggacagtcccggaaactcttttgctatcacaaacaaaggtgttgtcagtcgtataaatactagcactgtctaccgccatttctctcgttgacaagcccgttcgacctttgtatcactcatcttgttcacctctccccacacccgccaatctctcttcaaccctcggagtttcaccgactgaggtgcctcttaagacaaaaaaaactactatattctttgatacaaccatctactctcttcagacatgaacgccacagaacctccagcagaggcgatcatcggttcccagtacaatgctggggatatcgcctggaccctcgcctcaacagccttggtctggcttatgattccaggtatcgggtacttttactcgggcatggctcgctccaaaaacgcgctgtcgctgatcatgctctcgtgctgttccgttgcggtcgttaccgtccaggtaaaattcaatgcacccgggttgcatatgaccaaagttgccaaccttgcagacccctggaactaaattcgcgtctgactcttcaaccttaaaattaaacagtggttcttgttcggctactcacttgccttcagtaagagtggcggcaagttgatcggtaactttgagaacgccttcttccgtggtgtcttggacgcaccttctgtcggttccgctaagattccagatattgtcttcatgatcttccaatgcatgtttgcagccctcacacccgctctggctatcggcgccgctgcagaacgtggccgcatcgtccctaccttggtctttatctttttgtggaccacgttcgtgtatgactttattgcatgctggacttggtcggccaacggctggtcctttgtcatgggtggacttgattttgcaggcggcacgcctgtccacatctcttcaggggccgccgcgctcgcctatgccattgtcctcggtaaacgatccggcgatcagaaggacttccgacctcattcgatgagcaacgtggtcattggcacctgctttatctggtttggctggtttggcttcaacggtggatcggctctctccgccaacttgcgtgccgccatggcttgtgttgtgaccaacctcgcagcctccactgccggtatcacctgggttttgctggattatcgccatgaaaagaagttgtctgtcctgggtttttgctccggtgccgtctctggcctcgtggccatcacgcctgcctcgggttatgtctctccggcctcctcggtcgcgattggatttctgggtgcgctagcctgtaacatggccgtgcgtctgaagcaccacctcaagtacgacgatgcctttgatgtctttgctgtccatggtgtcggcggcattgttggcaatctcctcaccggggtgtttgcgcaggcttcgattgcctccttggatggcgtgacggtcattgcgggaggatggttggacggcaactggattcaggtcgcataccagcttgcggattctgccgccggtcttggatggtctttcacggtgacgtacttgattttggtgattatgaacaagatcccaggattgactctccgtgcggatgtcgctcatgagcaccgcggtctggacctggcagagctgggcgagaccgcgtacggacatcttgatgagaagaaggttaatacctccaatgaggttggagaaacgaacagcggcgtggagagtatcaagaatctgggcaatgaagtcaaggtcggaagtgtctcgactcttggacggcagcattcttgaggactctgtcagtcttgtgaaaataaccgtgataccaacgctcatttataataaaagcaaactaatacgtcagcatcgatcgtttgaacctttattgtaagtgcattgcaataaatacttcgatactggttcgcaaagacaagggaagaattatcgtcctcgtggaccatcactgtttcttcatttgctccttggcgatgatccagcgaactgcatcttcgacgtgttcgacgaccgctgtagctgggtgaacatggtggttttcaaggccctttggcatgtatactccagtcttgaccaagacagagttccaaccatagccattggcacctgcaatgtccgcgtacgggttatcacccaccgctgaaggccaggtgaaagaaggtgcagttagtacacattcaagtcgcgaggtgtgcgcgcagaggtttcaacacagagtgtaaccttaccgtagacagtccttttgctcggctggccatcgggacccgcctgcaagggagcaatcttatccagaagcgcttctgcatatttgtaagttgtattcaggggctttccgtagctggtatactcgagctcttgtcccgtcaaatgctatcaaagtgttgcggggtcgttgagatacgttgggtggtgtaaagcaattcctattcgaacctttcgtcagtgctggtggacgggtatgtacctgatagaccttttcgaggcacatcttaaacgagccttgtccgaagcggggcacagggtattcgttactccacacctagcacgaaggaatatatgcaataagtcgacgttgttttttttgaagatacgcttagtgtgcttggactatgaacgcaaaaacttaccacatcagggtttgaaaaataaataggaacactctgctttgtggcatgcagttcctccggcttttttatggtgcccaaggctccacctgcatggtgaaattgtcgaaagagcaagagttagtgcttagtacagcaggcgacatttgtttcgcgaatcgtaaatatccaggtggagtagcacacttgccttgagataccaatgcatctaggcagacttgcaaatcacgaccccaatcctcagaatcatggaagaccatgaccgcatcgactggctttttgatcttttccagcacgctctaagcaaatgttctgtaagctttagtccatggtccaattgaacatttacaggcgataatggtcgcataccttatccaaaggcgagggctcctcagtacatgtcgatgtagggcagacggaagggtccgcttggtgaagctctctgggagtgaaaacttgattgaaaccgtagtactctgcgacatctttacaggaatttccagcgcctcccaccaccatgatgttcgactcgcgatactttggcacaagggcgcgcatgggagaatgcgacacgatcaagtgatcaggattcacctactcgcaacagcacgtcagagagtgtcggaagggtgaggacttgctcgcgggcaagaagccgccgagagagcgattccagggagtcatagtgacagaatcccgcactatccagtcaaactctaatctgcgcctttgcggcgcgtctaatcagtaactggcgtccatctgccctacctggatgcctaacttcttggagagctgatcggccttctccgactcacgaacacccccgccgttagtgaggaagatgtaggggatgttgttcctaagcaaaaaggacgtcgcggggacattggactgtgagttacgactcactgctggccggctagatggttccagcgcagtcctagttgatacccgtgggagttggctgtcccactcactcatgaagcaactcgagagcacgacgggtctggggaatgactcgctttccctacaggtgccagagcgaggtcagtgctgaaacggtggtgcgaatggcctggtacgaaggcattgcgcgctggttggagacatgtgcgcaccttgatcagcacgccgtcaatgtcaaagacgatgttgaatggtgccgccttggcttgggtgtgcagcccgcgtgcgcggaatgtggctctgagagatcgcagtggcaaacacgacattgggatgggttgatgagtggagcgggtgatggcaggtcagggagacaagaagcgagagagtgcgacttggcgaggggatccaggacagggccaacgccctggggtgtgtcaccgccaccaaaacaggcttgtcaattacacatcgggctggtgggtgggcacttcccacgcatcggcatgggcagcattcctcgaactgggctggtgtacgtgtgggcaaaatatatgtatacagcccgtccaacggacaagcaggtgtgccctcggctgcaggttccctcttccgtctcctctcccgtctcgacacggcatgcatagacaaatgtatagactataccctttgctgcagagcatggcactccgccactatgaacattaaggtatgtcatcaactgcactcgcagaaggttgagcaagagcgaggcagaaaatagaacggctggatgcagcgccatggaacaatgaagcaacctaaatccgaggcagtaccccctaggagggtatcatgttctctcccaggaacaaaaaatgccgcacatgtgtgcgtggcattcccagcgagcaagtgctctcgaaacccatgcatgcagcccttgccaatacatatagtccaactttatccagcattctccgctcattcggtcgcggtagactacattgtgataccttcgcaaaggatatgtaagcattgaaccttcaatccctgggatgtgtgtccatcgtcgcaccacggtcgagcgcttttgcccgtgtttactgtttacccgccgcacacgcatacattcatacacacacacgcgcgcgcgcgcgcaaaccatatgaagtcgttcagagacattcctgttgagcatcgagaggccgagagaagcaataaagagcaagcaggcgtgcagcaggcagaaggtggttggggggggggggggggggcagactagtttcattgtgcatcctttcaaaccatcgctcgcgacttctgcacagagagcatgtgtgctggtactcccatggcgggaaatcgctgattgaacaatccaaaaagcagagcttgattgtgtcacctgcatgcctcgtccgttctctgcgcccttccgtagctcctaacctaattcgtgctgagtcgaagtctgaacgccgcctgcaaaaaagtaccctgtatgaaccacagtcaaatctcaagcatcttcatcactttcttcgccctttccgcgtggctggcctgacagcaggccgattagcctagtggccttttgttatgccgaatgttagaccagcacgaagtgccaatcaaattttataaaatgctgtgaaatctcttgcactgtcggtctctttctttcctgcaccctcttcccaacctcatattctttgcctcttgttccgtgttcggcatttctcactttcgaccaaaaggtgcccttctgtttatacacaatggctgtccgcacattccttgacgctgcgatccagtactctagtgctgtgacgcctcgttctgccttgatctttgttctcgtcaccgcacttgtctacaaatatcgatctcatgccgtgggcacccgccctcgccgggacctcaaacagcccagaggcgccgtcccattcttaggacatatgcccttgctcgccaccatccccggcaccaagctttacgactttttcgaaaagcagcaccgggagcttggtcccgtctggtccgtctctttaccgttcatgggtcgaatgatccaaggcgatgaccctgccatgatcgaatacgtactcaagaccaacttttggaattacgagaagggcgagctcttgaggaatacactggctgacatttacggtcgaagtaagtgttcaacatccgctacttcggatccgacattttttttttgttcaagattttgttgctgttacagagccattgttctagcttacccaccacagccatgctctattgtttgtttcattctctcttattctacaccacggacaaccagcgttcttcgtggttgatggcgaggagtggaagttccagcgaaagctggcaatgcaggttctcaatgtgaacgcttttcgcgagtacacaagtgacgtctttgcccaggagggccaaaaagtggttgattatctctacaaggccgcagacgagggaaccgtcgtcgactttcaagaactgatgcttcattatactctggacaccttcacaaagtgagtttacttggcgctagatgcacgtggccggtacacgagacacaaaatactcatatgcgcgtacacattgacacagggtttcggtcggaaagagttttggttgcttagacaacattgagaacgaggtcccgcttgcagtcgcgttcgacagacttctcagcgtctctgctagccgaatcacaaatccagcatggagaatcacggagcctctcacaggagttactaaaaccgtgaaggaagaccgagccatgatccgaaagtactacatcgagatcattgaggagagaagacgcaacggataccacaaggcaaagaaagacttgttgcagctcgtgatggaggtgatggacgacgacggcaacccactctcggaggatttaattgtggacattgtcttccagttgacggtaagcaatttcgccgacagacatgatgtgatgttatgacaggaaggcttatatcagcatatcccttcggtcctcaggtcgctggacgtgacaccactgcccaaggactttcatggatgctctaccttctactccgcgacggcgctgataagtccatcctgcagacgctggtccaggaagttgacgatgtccttcaaggggttgagccaacatatgacacatataagcgtcagaaatatgccgaggcttgcttctacgaaggtaagaggactgaatgtcaatgtgattgttaagtcatgcaaggggctaccctcgggtacatgaaacgtacgtacatccttaccatacatttctcttgcaattcagctcaacgaatctaccccggaggtacagtgctatatcaccatgactagtcacgacaatactcttcgaccatgacaagtgacgaccatgcaccctttgaacgttagagcgctggttttaaacattcctgttgttttattatttcaacatccactaggtcctcgcaacttgaagctgtgcgtttctgacgatgtcttgccaggaggtatcaagattcacaagggcgagtggttcacatggagtccctatgttatgggcaggagcgagcatgtctggggacctggtaaatatagcacctcggctaagagtgcaaccattttgaaacagaggtttcgttcttacacgcgttcttttattactatcttttatccagatgtgttggaattcaagccctcgcgctggttgaatggcgaaaggccttctgcaagcaagtttgttgctttcaatgtaggtccacgcacttgccctggtcaacagttcgcaacatgcgaagccctgaccgttttgggcatgatgcttcagtctttcgagctggagcttgtcgattccagctcggtcccagcttacggcgtctccttgacgttccccatgctcaatggtcttcccatccgggtacatcgccgcggcggcacgaaggttgtatagacaaaacgacagatatggctctcactgctttgaacaatcgaatacagctcagtttttgcacattttcttcctatatgcagtggccatgaggtgcgcaactttttgctttcatggagccaggatataggatgatgggatcattttggcgctttcaggacctgctttgagttggagtgatttgacatgtgcgtgttttgaaacactggtgcgtgccaacatggcttgtgcgctgtcgctctctccattgctcgtggtcgtgggatccctgcgaacggcattagggtgggcctgacgagggcacgatgaggaaggcgtagtcgatcgcttggccaaaaaggagaaggacgagctgcggcaagcgtatatggtgtggaaaggcaaggaggtcatgcaaagggttcttgcgggccgcgacaggcatctttttaatttttttatccgctgtgcagaccggacgacagctgcgctttgctttttttttttttttttgcgctcttgtttatcacctttcctctgctcgcttctcttgtcatcaccccactccgtcttctttcctgcacccatccttgctgtcttcattgacgcgcactcatcactgaagacacagcataacaacattcccgcgatccgatctgtgattgtccttgtacatggaaatccatctgacgcaggtgctggccgtggtccccttggcgctcatgctggcctcggggaccatcggagcccttgcctcacgatcctccaacattgagctaaatccgtctgctgccccgcccgtggcagctcagctggctcgtcgcaagtccacgtttgactacactcgcctcgcttcagtggacgcccaagagccctccacgacgacggaaacacagcccaaaggcatagagatcaagatccgtaccatctcgctcttccttctctccttggtccccgcagcgttagcagtcgtgtctgtagtgttgtcgttagattctagatcggatagatcagcgttcgagcggctttttgcacccgtggtgaccctggtgggatggctcatcgtcctggcagcgctctttgccgtcatcacccaccgcgtccgcttctcgtccaccattcaatcgctgcagtggttctattcaagcgcacttgccgtgctgatctacgagttctggaaccggatcgattttatcctggagggcgtcagcaaatacgatttagacatgtggctcttcctcgcagggttactgactgttctggtggtgtggacaatcgcactgacaatgcctgcagaactcgacctggactttgtgcatcagtatggatacggctattcctccgtaagtggacgcctcgtgctatcggtcgccattgagccatggtcatgatgacacatcctgtcccgcacgagtgctaatattcgtccttgatttcgtctacggcgcatggccactagccggaacatgaaatgagccccgaggcgtatgcatcgtacctgtcgtggctgttcttctcctggttcaacagcgtgatcaagctcggctcctcaaagaccctcaacctgtctgatctccctgagctgctcccccagctgcgggcgcgggtggtgtggtcccaatttcagatgttccagaacttcaggtgagaatgacaaatgcattccacctatttcctctacttttccccctccgactctttttctttccaccccttgcaccaccctccgccctccccttgacacgcaacttcgctcttcaatttgccatcggatctattcttcctttttcgggtttcgtgttacgcaaaaaaaaaaaaaaaaaaaaaaaaaaaatcacatcgtgtgaatgctctgtccggataaacacctctcagtctatctcctgactaaccgcttgtacactctactaacacccgcgacatcatagagcatcggcatccctcctgaagcgtgtgctactattcaacatcgtcagcttctcctggcaattcacattcgtcgtcatctcgacatgcctcgatttctcggttccttacttccttcgcctgtttttgaagtacatcaaggatccctctgttcctcccaagatggcgtatctctatgtcatcctgatctttgtggctcaggtatcgcggtccttggtgcagtcgcaaatgttctacatgggacgcaagattaatgtctcgatgatggctctcttgaatgcagagatctatgcaaagacgctgacccgacgcgacatgagcgggttggtcgataagaagaacaaggacgtcaaggaaggcaaggatgccagcgggaagggcaaaggcaagggcaaggataaggagagcagggacagtgcgcccgccagtgctggaaaggtcgtcaacctcatgtcgactgacactgttcgtgtttcgggcgtttgcaacttttggcacattggagtctcctcgcccattggaatcgcccttggcacatatctgctgtacgacctcattggctggagctcgctcgtgggcatgtccattctagtcatcaccatccctgtgaacaaggctgttagaaagagatatgccaagggacagcgcgaattgtcaagtgcccgtgatgatcgcgtcaccttgatgggcgaggttagttggctttttttttcgctcgcagaaaacatgatggctaacgtagtgaccgatgcagcctactgatttttctttccttcgttcaatatcagctgattgctggaattcgcatgatcaaattctttgcctgggagctgtcctttagcgaaaaggttttgaaggcgagagaaatcgagcttaagaagctggtcaatggtgagttattgttctggcctcgacagttaggagcgggatacatgtactgacaatgcttttcattctttcgttcttagtttacaagaataccatcctgttccagctggtgtggttttcatctccacttttggtcaccatctcgagtttcttctgctatgccaagatccagcaaggacagttcacacctgatgtcgccttcaccgctatggttcttttcacccgtctgaaggctcccctaaatggtctccctgctgtgtacatggctctcaccaacgccagcgtcagtttggcacgcatctccgagtatctggatgagcccaacatcaaggatgtgtttgtcaacggagtgaagaggcccaatggcgcccccgaaatcggaatgaaggacttgaacgctcaatggtggaccacagagagcgccaagactccggacgcgaatgctccagaggcgacagaacctcgcactgaggacacggatcaattcattttgcgcaacatcaacgtttccttccctgttggcgaactctccattgtctgcggaccgacgggaagtggaaaatcctcacttttgctggctttgctcggagaaatggatgttctgacaggacaaatctacttgcccaggagatctctcgatggatccaaggagtttgaccccgaaactggattgcttaacgacggagtcgcttatgtttctcagcaggcttggctccagaatgccagtattcgcgacaacatcttgtttggcagcaaatatgaagaggcgcggtatgagcaggtcattgaggtctgcgctctcaagcgtgacctcgagatcctggagtttggagacaaaacggaaatcggcgagcgcggtatcacgttgtctggaggtcagaagcagcgcgtctctcttgcccgcgccatctactctcgatcccgtcatgtgcttctggacgactgtctttctgcagtggatgcccatacagcagaacacattcacgccaaatgcctgacaggatcgatcatgaaaaatagaacgtgtgtcctggtcactcatcacgtccgactctgtatccccaccgccaagcacattgttttgatgaacaatgggcggatcacgcttcaaggatcagtgcagcagctccgtgaacaaggaactcttggccaggtcctggaggaggacgaagagcccagtcccgattcatctgacaacgagacggtcgcagaaaacgatctaggatccacgtctaccattgctaacaagcccaaggccatccgccgcaagtcgacagccaaggatctcaatgctgtggagcagccagctgcgcctgccaaggacgcacaaaagctgattcaggaggagacgcgtcaagagggtcgcgtcaaatggtcaatttacatggtctatgcatctgctgccggcggtgtcttgttttggttcaccctcatggtggcctttgccgtgacgcgctcgatcgaggtgtcagaatccctctgggttcgtgagtgggctaactcatacgcacctgagacggccttcggcaagttcatgttttcaagcgtcgcctcagcaatgggattctcgacgaaacatctcgccacctcacccatttactcagaaagccaaggattcgacagcttacctggtttctatgacccagctcaagcggtgacgaacaagaccttgtcggtcatgggtatgggcgcagaatacgccatgggtacgcccgacaaacacagcaccgactattatctattcatctacgccgttatttcaatctgtgccagtcttgcgcacattgtccagacaatgatcgtgcttttcgggtctcttcgcgctgcaaggctgttgtacaagaaactgctcatggccgtcgttcgagcccctctccggttctttgacacaacacccgtcggacgcatcagtaagtgccgtaagctgtggaaaagtcgtggtttccattttaaaaacatatctttaatccctctttttgatgcattgtgcctgctgctacagtgaaccgcttctccaaggactttgagactgtggatggctcgatcgccaacaactgcgcccagcttttgtcgctcatcatgtctgtcagctcgatcatcattgtcctggcttacatcacgcctctgttcgtcgtgatcgcagcgctgatttcggtggcctacttggctgtcggaagaaagtatatcagctcgtcccgagaactcaagcgcttgcactctgtctctcgctcacccatttattccatgttcggagagacgcttgcgggtgtagcaaccattcgtgcgttcagtgagcagagcaggtttatgggcgatcttctggtcaaaattgacgacagcaacagacccttctactttctctggattgccaaccgctggctctcggttcgctcggactcgatcggtggagttgtcgcactgtcatcgggcatcttcattctcatgaaccctattggaattgatgccggaaccgcaggtttagccttgacgtatgcgttggagtttgtggcactggtcaactttttggtccgcgagtacaccgagattgagatggagctgaatgcgattgagcgtattacggaatacacggtcatggcacaggaacccccagccgtgattgaaggtcgccggccaccagccgcgtggcctaccagtggaagcatcgaggtcaaggatctggagctgaaatatgctcctgatctggaaacagtcttgaaggggatttcgttcacggtcgaatctcgtcaaaagattggtgtggtcggaagaactggatctggaaagagtacactggcgctgtcattgttccgctttgtcgagccagtcgcaggaagcattcacattgacggcatcaacatttgtgacattggattggacgacttgcgctctcgacttaccattatccctcaggaccccatgctcttcactggaactatccgctccaacctggacccattcggcgatcatgtggatagcgaactttgggaggcgcttcagcgcgtgcatctggtcagcagcggccaggactcgttagccaacagcgacgatgaaggcgaccagagcaatggtagcaatgacggatcggcttcgtcttcgaccgccgccgccgtatcaacggcagcagttggtggtggaaagacacacatctcgttttcgagtctcgataaccccgtgagcgagggtggctccaacttttcgcagggtcaacgccagttgctctgtatggcgcgcgcgctgctgaggaattccaagatcatcgtgatggacgaggcgactgcatcggtggattttgcgacggataaggcgatccagtcggcgattcagcaggagtttgagaactcgactgtgatctgtattgctcaccggctgaacacgattattttgtatgacaaggtgttggtgttggaccatggcgaggttctagagtatgacacgcctgctgctctgctagatgatagccagggcaagaagacgcatttccgagagatgtgcgagaggtccggagagctggacgtgctgctggagatggtgcggactgccgaggccaagaagcgcgcagtttgaagatctcactgctagaatgtaataaaatttgccaccaacctcgtcctacaagcaaaaaggtcacaaatcgtgtaaacaaagattattttttttttggctaatgcatccctttgtcgacactgacttccaacccaaccgaggactgacgaacaatgggcgacaccgacaagaagcggaagcgctccaaagaggacaaggacctgaagaaggaaggaaaatccaagaagacaacagaggcagaggtccatgcactctccgccattgagcaggaggctcctcgcaagaaggcgaagaaggacaagaaggatacggaaagcatgaaggacaagaaggagaagaaggagaagaaagaaaagaaagagaggaaggccaaacatgacaaggaggaaaaaaagagcaaaaaggaaaagaaggataaggagaggagctcagagtcagcctcatcggatcagagtgatcacactactccttccgacgacagctctctgtcaagcacctccagccccgccacgagccctagatctagcgagaccgaactcaacatcacgccaatggagatcacggaggagcaaaaggcaacaaggataatcgtcgagattgcgaccaaagccattataactgagaaggaggacaagaagagcaagaaggagaagaaggagaagaaggaaaagcaggacaagaaggaccaagatgtcacaatgtctgaagctaccgacaacgccagctccaacgttaatggcgagggctctggggacaagaaaggattcttcaccgcccaaattgcacccaaaggtacgtcatcgcagccccgctcctgttcgcatcaaggagaattacaattgtaatgaaaactatacttactaagatatgttgtttctggtttccttatcattatagtcgatgagaatggtttgacaaggaaggagcgcaagacgttaaagctcaagcagaagcagcttaacaggaagtctgaaggcgacggagcaccagggttcgttctcaagacgggacacgacctcactctcaaggtaagcacgataaaggagactagagcgaaaagtacctgattattgtgaccatttggatagcaatgggtgttcttctatgtactgcttgacgatatttactgaaaatatcgtttcttcgtatctggtgcgttaggacttgcgcgatttggtggtctttattctcacagagacaccaactttgccttgggttcaagtcctcaacaaattcaaaattgacaaggtccttatgctctacgcctcaggacttgacccctccctctttcatatcaacctcagatcgcccgatgcgcacaaacctatcgactggccactgcgggctgctcaagtgggcggtcctgtcactgaactggaggcgttgaaggaacttcttcctgagatcaacgtggtcaaggcaccaggagacaagtttaggatcttttcacccacaaacacactgttgaacgtgccgttgagtaattcagagaagatgaagagggagaaggagaagcaaagtaagtggttcttgatatctgcactctcgcgccaaagagacaataacactcgtattctgcctcgaatctccgaagacattgttgctaacgttgaatgtcttccgatggaaagataacaaggctgccaaggaaaagaaaccagagaactacatgctgtccctggaggagctccgcgagagcgacttccctatacctcgctatctggattccaatgtccctgatctgcaacccggatggagcgagaccccgaagctgcccaagaccagtttgacaccgccgcccaagatcatgattgccatggattgtgagatggtaagaactgtgcacttctttgggcgtcccgcctactgcgttctctatgctgcaagctttttgttctgctcctggcttgctgacgattgcacgtgtgacatcgccttcacgaataacagtgtagaactgccattgggtcagagttgactcgagtgacgttgattgaccataatggcgcgactgtcctggatgagctggtgatgcccgagaaccccattctggattacctgacgcagtactctggtatgacagcagcacgtctcgaaggtgtcacaacccgactggccgatgtccagaagaaggtgctggaaatagtcgactacaacactatcctcgtgggacactctcttgagaacgatatgaaagtgctaaaggtaaaagacgccgctctgcatgatcaagctgtgaaattgctaaaaactcgtaaactccatgaaccagcctgctcattcccgccagcatttttttttcatacctcaccccatagctcgctcatcctttcatcgtcgatacgagtattcttttccaccacacccgaggacccccttaccgtcccggacttaagtggctagctcagaaatggctctcgcgtcgtattcaggctaacgtggaacgtggacacgactctgcagaggatgccctcgcctgtatggatcttgtcaaacttaagctgtcaaagcctctcggttttggagaatatgttcaggatcaggagtctctgttctcgagactgacacgcttcaacatcccaaggacttcagccctcattgacgctgacgcgtttgcgggtcaggctgcaaccacaaccatccggacggccactgatcaagacgtggtggaggcgattccagaagccatccagaagcataactttgtgtgggctcggttaagagatgtcgagatcaatcatggtaaagcgcccacggttgtcctagctgagggtcagatcgtggatactggtagagcgtccaagctgagcagtcgcgataaggttcaggcaactgaggaagagatccgccggggtatgcgttccatcgaccagagtatcaagcagatcatcgagtccttgcctgcgaggacggcagtcattgtgaccagtggccagggcgaccatcgcgaggtgtccgagatgcagcaccggcagaaggtgtttgcagagctgttcaagactaagaacctgtctgagattcctgaagaggaccggttcacggaggaggatgagcagaaacttgcagaggcggtcgagaaggcaaagagtggagtgtgcttcttgatggtcaaaggagaataggcacgattaaaaaaaaatgcaacctgtgcgtaatgtcctccctatcgcatccccatgtccctatgtgctctctcactcgcctcccttcctccctccttctcgtgtttttctttgtaaagttgatagttatgccacactccctaggagaaaagaaagaaggagtagaaatcgaaggggaatgtatcctcaccctttttttttctttcacctcagctccttgttgggtcaacaaaaaaaggggaggggaggaaacgatgtctgtagaaaatcaatggcaatcgttgcgaacagcgcgtcaatctcggccatcttgttcatacttacaggatacgagaaaggggaacaaggagacaaggaagggagcgaggatagctaatagatcgagaagcaacgagggtgaggtgggtgaaagagaggggtcgatgtggtgcgctggcccaatgagtttatgacaccaacaaaaccaacagagaaacgaaataccgtgcctttgcatctctgggctttgcgttgacctagcagagagaaaatacctttggtgtgaatggcgcgcgcactaaccacccagaaaggcggtgtagaagacacctgctgtggtcattttcatacaaaagggatcggactcgcagctcatcccccgaagcttctgttcttctgcttgcctctcacgtctctcgccatcactctgcgccccgactcgtcgcctcttcactctcgacgcacacacagcaatacacggcatccatctcatatacagaatgcgcatctctactgcgatcgcgttggtctccttggccacaacagccatgctggttcatgcctcggacgtgctcagcttgactgcggacacattcaaggcctcggtctcgcctgaacaaaatattatcctcgtggacttttacgcaccatggtgcgggcactgtcagaatctcggtaagagttcctacataaacctctaggatagcagagacgccttccttatgagcgagggagaaaaaggtaatggcaatgcccgaagcaaccactaacacgcttcatcccgttgtctgctactcatcctcgatattttagagcctgaatacgaggccgctgcaacacagttgaaggaggctggcgttcctcttgcaaaagtagactgcacggttgagaaagacctctgcaaacagtacgaggtcactggttacccaacactcaaagtcttcaagtatgtaacccacttttgcttgtccacgaccaactttacaaacggaatgaaagcgctttcagttgagggtggtttggcctggaagggaagggggagagagactcagaaaattcactgatcacgatagtccccgccccttttcctcaccacaacgtgaaaaaaaatctctttactcaaactcttactcctttttgccctcaacctcattagagccggcgttcccaaggactacaaaggcccccgcaaaaccgatggcatcgtctcatacctcaagaagcatgccgctcctcccgtcacggagctcacggccgagtccatgcctgcgtttgctgcgtccgatcgcgtcgtggtcgttgccgttcttcccaaggacagtcccatgcgggccgaggtcgaaaagattgccaacttttaccgcgatgactttgtctttggtgtggtggaggagcaccccgacgtcaaggcccccggagtggtcctttacaagaagtttgatgagggcaagaacattctcgaaggcgactttaccgacgcaaggctggtcaactttgtgcgaaccaattgtctgcccgtggttgacgagattgggcccaccaactatgcgcactatatggactcgggcacgccactcgcttatttgttctttggcaacgctgaggataaggccaagtatggtgccgacattgagggtcttgccaaggagatgaaaggcaaactcaactttgttttgatcgacggcagcaagtacggcgcccacgccgccaatgtgggactcgaggccaacaagtggcccgcgtttgcgatccaggatgtcaacacggccgaaaagttcccgttggaccagaactcggaccagcctctgtcgatggagaggatccgtcagcatgtgaccgatgttgttgcggggatctacaaggccaaggtcaagtccgaggccatccccgagaccaacgatgggcctgtgaaggtggtcgtcggtcatacgtacgaggaaatcgttgagaataaggatcatgatgttctcattgagtactatgctccctggtgcggcttctgcaagatgttggcgcccatctatgaggaggttggagcgctctacaaggactcgaacattgtgattgccaagatcgacgccactgccaatgatcttccaaagacactgcccttcaccatccctggttaccctacgatcaagttccgcaaagccggatccagcgaatacatggactacagtggcgaacggagcacagactcgtttgtccgcttcctgcaaaagaacgccgtcaacaaggtcgaggtcgcatacgagcccccactcaagtccgaggccgtgccagagaccaacgatggccctgtcaaggttgtggtggcgaatacgtatgagcagattgtcgaggacaaagacaaggatgtgatgattgagttctatgcaccttggtgtggattctgcaagatgctagcccctgtttatgaggaggtcggcaaagtctatcaaggatcgaacattgtgctcgccaagatggatgcgaccgccaatgacatgccaaagtcgctgccgtttgcagtcagtgggtacccgaccatcaagttccgtaaggcgggatcgactgagtatatcgattacaacggcgagcgcaccaaagagggtttcatggagttcttgtctcaaaacgccgtcaacaagctggaggcccccatggctgaagaggttggcaacgagaccaagaacgatgctcctgaggagcagaagcacgacgagttgtaaaagaggcgtgttttggggagtttggattgatatgtatattcgcgtggccgagcaacaagcaaatgtaaattaaaaagcaattttggcgctgttcctcatcggcaattctgtgatatcttgtttcgtttattgtacaaaaagagggttgaataaatcggcttcgtcctcggtctattcgtcatagtcctcctcgtcgtccgcacgcttacgcttccagagctcgtggttagccatgttttgttggttctgggagagcggctcttgtgtagcctccttcatctcttcgtccgagtcctcttcgtcctctttgatcttgaacaatgatggtggctcctcgccctgtacatctgctgtcgcatccgtgggtccgttgtgtgatgctcgtggtggtagctaagaaaggatacatgacacattacacattagtctaatacagataaaggcctattttttcccgccatggcagcgattccaaaaagttgcacatacctcagggataagctgaaaattgaccgcagtcagacagtggcgctcgtggggaaggcggattccatacttttcggggatcaatggcaatggcaccttgttcttctcctctgcaagttcaaggaggaactgaaataacaacccaacattcagtttcctttttgttttgtttgctgggttccacattgcgtaccgttggcactacacccttacctcctttggtggtggtgctgtgaaagaatggttgactctgccctggatcgccaacctcacatcgtccagtccgacctcagttcgtcctgcgtgctccgagtaaagcaatgcgtcttggaagacatctgtagtgtaacctagatatgatcgagttcgcaacatattgagtgtctcctgttgatcgaacatttttccagccattgaagcagagcatggaacatacggtgggcaaactcgagtaattggtgtatgactttttgctctgcatcctcgaccgaaagagactgtaaaatcagcgaaatgactaggatgcgacacgtcgagtgaatcgtatgtgagatgagtagctcctggaccacggtgcgatcgctcaactgaacatgcatccctttcaagtgttatttttgatgcgactcgtcctgccataccctttgcatctcgtggctgtggtgtctgtgtcatgctgttgctgctgtgggccttgtccacagttcgcggattctctctcgattggtgctggcgtgtaatcagaaaatacaattttttgtttttttatttgtctgctaaggtcggtgtccttatacggctcgaaatttaagacaacgcttgcatcaaaatcatcggtcgtagtctcgtagacaacgctttaaaaagacttgcgagactttggagatgtcgtaaactgggtatggtgaagcaacttcagatgacttatatgcctatatcatggctgtatagtcagacgtgttttacatgccgcacgaacctcggtggttccgttcaatccgttcttctcaaacttctcgacttcagacttgatccagggaacatatggcttgatgaacgtgtagtagctgtaagtctccgttctcgccacatgcttctatgtcgccagtgctactgaccacccccactatgtgcaagttctcgccagagccagaatagagaggtccaccggaatcatccatgcaatctgaaaagccgagcttgtccgtggcgcaaatctgggtgatagggtcgaagatgatggtcccgcctcctgtgttgtgctccgcgcaatcagtttcatttccgatgttcatttggaccttgagtaggattttagatgtagggccattcgtgctggttcctatgtatgagagaaatggcatgatgagcaaaccataagttggccaaagcgcaaagctcaaaggtgtcgacttacggccataaccagctaccatcagctgcgaccctgcttcggggtaggaaatcccctcgattgaagcatagggtccgtcaactttttttgagaggaaaacaagaccaatgtcgttgacgagcttcttgatatcaaactctggatgggtaatggccttcacgggcttcaagagcttgccctcatcgatattgacgccaccaagatacgtcgcgctatcgggctcctatagagtacttgtcacgagtagcgttagagtttgcacgagtcctccgttcaagtggaggtaagtcttgcaagtcgacgatataacatccagtacttacggcttcaacgcaatgccccgctgtaaagaagataagatgatatgttactctcatgaactgaggtgtttttgacagccgctgtacttcgcttacctgttacgatagtctgcggtccaatgagagcgcccccgcaaccattcaactgcacaaaggacggaagctcggccaccttaacgcgtgtaccaccacccactatgagtttgtgcagcgaaatgcttgacgtcgtagcggcagcaatcaaaaaatgataaacaccgggatggttctgaagtacattgttgatgaatgcggcagcgttaggatcttgaaagaaacggtctgttgagtgagaggagccagaggatttcgtctgctttatacacttgctggtaggtgaccaagtattcctcgactgttgaagaacgcacctgagcgcgtatccccatataaatagctgcgcctcgaacaagtggcatcgaagagctgtttgtgagctaccaaattgtagcagtgcttcatcaactcgcagaaaagaatcgtgaggaagtgcttcaatatactccctttgctgtacaacgtgcttgccactgtggtcacaggtcttttgataccgttacaatggtgcaaccggtatagcgccctaacccaaggatacgtatgtcggtttctgggcctgtctgaggtaaaagagggtcggtagtgagcgccgcaaaataggaaacgtgatcgctggagcgcgaacagtcgatagggagaaaatctgagagtcagttacgcagtccagaccagcatctggaaaatgaacttcgaggctttgagcttcaaggaatatagttcaaggtttgcaacgcatcgaaaaactcgagagagattttattgcactaggtatggtatggcgcagagacggttgtccgagggaactgtgcatgctattatgagagaggtgcctgcaccagctgtatccgcacgacaatcgctatgaagtcttctccttcactgaagatgagtatgaagttcagtgagatatcaagcaaaatcgccaatctcggtcacagaactaccgaggtcaatactcagtcagtgtactgtgctacaaagctgcgcccatggcgacagattgtcactgcagcatagtttattaagtttagagacatataagaaaaaaaaaaaaaaaaaaaaaactacaagcagcaacaagaaattatctttgcagttcactattgcctgacagcgcgtcattcggcttagccctactctgggcgctcagcaccatgtaactttcttcttcgaggcggggcaagttcattcttaagaatgaatgcggactttaaatagagctccgtctcggcaaaatgcttgcaaacagtgtgaaatacttcgatgtgcctatagtccatatgcccggctgagttatcggaggactgagaccattgcggcaacctgcacctgaagattccgaaaatgaaggaatatgacaaagccagcggcaactgccttcccggcgctggcccatgttcatgacgattccagagagtgaggcatgcattagaactccggggagtcttgagggtccaattcttccactataaaagacaagcaagaagctttgcagagtcttcatatatatttcactcacaccgcatcgttatcatagccactcaacctctcacttctctctctaacacacaatcgcaaccatgttcaagttctacttcagatcttcgcgcgccagcacttcttccaagcactctattgtccaccctatgggagcttcgtctagctctgccggccgcgccgcaatcgaacaaaccaacgcgcccatgcatcgtgaaaatcggcacattcatcaccggggaagaatgactgatccatcatttgcagacaagcccacgccagagaatgagaaaactcgatcgatcggagcaagtttcctgaaagctttaaagcgtcgtcattacaaagccgcctagtgggcataactttccatatcattatagaaccccaaaagtgtaaaaacgcgcaacctgtaccataaacaacttttagcattcataaaatcccaaccacgccatcttttgatatcaatacagggagatggagatcaaagtgataacagcttgttggattagtttttactagaacttgatggccatctttgcctaggcgttagacccgcggggtgccccccctcacctgtactttattgcttgacctcagatggttcatttaaaggaatacaacatcttggcctatacatgatctggtactgacaactacgcaaaaggaaaaagatgccacaagaaaacccaacctgccctgagcaagcctcaaatgccggtcgcaaaggtcatccaattcatgaaggtttgtagaagcacgtttgctgtcaacgcccttaatgtacgccaaaagctggaaagtaggaagtgaagtttgatcaggcaagtgttctttatcctcctcaatggattagcgttagatagagccctagctgaaaacaaccctttcgagctggccagcgagctactcatatcatgcggctcgttgcagagatttcattttgatctcaagcggggcaatgtagccctcgtgcggcagagactctctcgagcatgccactcgctgaaagacccagcactgttcatcgtgcaagcccttgtgtcgatcggcaccgtgatcaaggccagaaatatggaaagcgatctggggctagcgatttcgcatatgctcgtcgagtcgtttgagttttatctacgggcgttaaaagaaaccaagacaaataactccagtactgcagaggttccaagcgccgagaacgtctcctgtgcatcccagaaggagaagccttcagaagcaccaacaccgcgagagaaaaccagcatcgacggatgtctcattctgttcgaagagtgctgcagtgacgatgggggtaatctaacaggagaggttgaaaaaggcgcaagcagtcatcccatgcctatatccacagagatggcagatcaaacgccttcttccgctgagaatattagtcctcggctaggctgcgacgccatcagtcgccatagccttcttgcctgcaacgagggctcaggcgacagcattcatcgggcgcctcaacccctgcaggactctgaatttgccgaaatgccttggaaaggaaatgcagattccgcattggtcacatcctcgctcccgaaacaaagcctccaagccaaggtgaatggcactgcggctgatgggaagggtggtgacgaaattgctcgtctaccaaaggaggccctctcgcgaaatagtccatcgttacctttgagaagtatatcacaggagggcgttgacacgttgagaagttcgaatcaacagcaaaatctttcctggctgtccggcacaaatgacccaaactctacctctgccgcgagtgtgggagagatacttcttgatcccaagagcaacatgaatccgatccagcatcggcatcaagaaacgcttctaaacgagattgcggcgcgtaggaattccttgcaggttttcgtggcacttgatgtgtttgagatgcggccttgccttatgcggcctttagacaggaaccaggaaaccttcgacacgtacgggtccacactggtccgtcagttgctggcgatagaacgtctatatgaggctacagttgtcgtctcgcggttcttttacgtccgcgatgtgatgctagatcttgaacttctctcgcggctcctcgcgcttccagatggccatcaagatcaagctgcattgctgcatgagtttgtcggggaacacttggacacatgtcaagtcgtgctgcaggaaattgatctgcggctctcgatacaacttgcccagtggagtggcgaagacaatgaaggcgatccaagtgttgccgaaatgttcaggtcctcttcgccgtgcgcaggatcttcgtatgagctgatgatgcagattttgtccatcacttgcgcatgtgtcagacttgtagagcttgctatgagcttaatgatgcgctttcagatcgagaactcaccgccccattaccctggcatacttttcttccgtcgattttgtaccgtcaggacgctgctcgagtaccgaagctcgagtccggacagccaaaatcatcagctcttaccgccaaccaaaagcatgggaagtgaacacttgatcgcacccgctcttccacgcccttgggtgctcattcctatccttttatctacaatcaaggacgatctgatgttacaaatgctgacgatccagtactgtcttgtcgagcgaaaagattcggtcacagccagcttcctcgccaccaagctgggccttggtgagtactatcagttctgtgctgctaaaacgcaaattggccagccgcaggcagtggtagattcaatccagcgggagcaagcacgtctcccaaaaacgcagcccagcgcggtcatctccacttcaaaaatcccgccctcgagccgatggctagagccaacctcggacttatggcgctccccctcgacttggccgcaaccagctccaaaatccgcaccgccagcgacaaaccacctggatttgtcgtttagacctcaactaaatgagcaacagcagcaacagcagcaacaacatcagcagcagcaacagcagcaccagctcccgacgcgcgttcagaaaccacgatgcgtacaatctgtgctccccttctaccgcttgcctgtcaacacctccgtgatcctaatcgacgatgcctctcagcttccacagctttggagcacgctttgccaatcacgagttgtcggcatcgactccgaatgcaagcctaccatggattcccgcgacttaacccagagctacccacgtcgcagtgtctccggctcggccacgacgcttatacaactagcctgtgattatgacaaccgagtttatctccttgacgtggtcgcactgaagcaagactgcggcgaacgtctggtcaagatattaggcaacctgtttgcaaatccgagtgtgcggaagatcggtaagcgcgccggattcacttattgacgctcggtcgctttcttccacttattttttgttggtcactaaccaaacatcattatgaaccgctttttagcatacgattggcgggacgataaaactcgtctagagatgacatttcccgcgctccagcataggtgctacgaattgcagaaccttgtcgacctgcgctacgtctggcttcactaccggtattgcgagttcgctatgcccggcgcgagcagaagctcgacgtccattagtagctgcaacaatacttttaacaattaccatcacgtcgataaccgcattatgctcgctgaaagcccttggcgatcgcttagaagggttgaaattttagcgtggtctacgctctcttatagccctggtctcatgagccgctgctgcggaggactctcagttatgttgataagactctgtggcctgagactggacaagactttgcaatgctccgattgggaacgccgacctctgaccgaacaacaaaagatttacgctggtgaggatcgggcttaacttgtgccttgcttgtccccatggtcttcgttatcacttgcaacaatgctgatcgaggccgtgctggccatcattttctcagcgatagatgcacgatgccttatggacattcacgaagttctcgctaaggctccgaggatcgagtaaagcactatagtgtatttttcgccattgaccgtagtagtagtacacgctgtgcttttaatacaacgggcttccttctacatgttatctcttaactggtcaccaatgccatcgtcacttgttatccttccacggtggttgaattggccttgtgtttaggatcaaaccggaatgcctctggagctggtcccaaaatcatatcactgatctttatccagtccgtgacactttgggaggccatcaaggtctcaaggtcattgcgtccaacaaatgccggtgggcggtcgttgatcttttgaggcagcacttccagcaggccagcaggaacgtaacggtgcaggaaacctaaagagggaacgggcggacggttaacgttgagaagagccatgataatagcaacataaaatcgcaccaacaaatgagataggtgcacctactttgccattccaacaagaagcgcctagtctggttaacgccctgggtatccgatccccagtgctccagtccatagtcgcagaaccgcttcagcatatcgaatcgttctccagatgaaatatcccagtccctgttggtcttgatctcctcaaaaatccagggcttcatgagcgcgcctcggccaatcatgcatccgtcaaccttgtgctgatcaaggtggcggtagtaatcggagggtccgagaatgtctccattgccaaagaggggcatgtaactgtccgttcctggaatgccgcgatcctgcgcagcgcattcgctgatatagtcccagtcagcaagtttggtgtatcgctgttgacgagaccgtccatgcaaggttccgagggcggcaccgaggccatgataaatgttggtcagattagtgccgatgggctttttgtcgtagatggccatcctgaacttgacggtaacaggaacatccagaacgctcttcattccagtgatcatcctcttcatctttccttgcgactgcaataaaccgcttccagaaccctaatcacatagcagagggttgtcgtcggtaaggtgatcaaagatattttaaagcacgagagtatacttcgatacttacggcgttaaagacgaggtcgatggggcagcccatattcaaatcaacaaaatcaactgtagcctgctggttgatcatgtcgcaagccctgacaacaacgtcaaccttgtttccagtcagctgaactccgaagatgtcctcactcttgtgccgcctcagaagagccaactctgccttttgtccctggaccaagtttgcagccatagccatctcaccgcaggtgatatcaaccccgtactccttgcaaatgcgtcggaagggaagatttccaacggtggtcaagggtgccaagtacgtcttgcctctgaaatcgatctagttttgcaaacggtgcaaggacagatgttagagataactgtgtagcccatcatttcacccggtacacttgatagactctagagtcggtaccttcttcttctcgcaaggacgaagacggacatcgggtgtgtcgctgttggtgacttcttcctgaacgatggctgctcgtggcttcttcacatctctattctccaactctgacagatcgttctcgtcctttgcaacagcggtttcggcggttgatgcctcttgtgcgatgttttccattgtaacgtcctggttttccatcgtagcatcctgcgcggcactctgctcgttagcgccgttgtccattgccttgtccttttttgcctgctgctccaccttgcgggcttctgctgcctcggcttgctcatcggccatttttttcaggtaggcctctgatctcgaaaagtcaaactatgtgaatgtagcaataacgttggtgccccggaactttgtagcattgcatccttgcacaacccactgcgtgaatttaatcttgcgtaccttgtacgagcggaggtcaagagtaagctgatgcgggaagacattcattgtctccaattcggcctttgccatcttttcctcgttcttgatcagccttccttccgcatccatatgcgcgcccagatagcggcatttgtatccatagtggcaccttaatataacgaacaagctcggtattagaggcggtcccgcgcagtgatatttcatcaattcgcactcatggaaggcttcacttactcgccaaacttttcaaagttgacacagcgatcgccaatgtccttgtccttggcctcgaggtactttttgatgtcgtgtgtgaacttgcagctaacggggaaagtggtagggatgttagatgagattcatcaagactaatactgaatgaaagcgcgaccaatgtactgctcatatcccatatggcaatatgctgctacctttcaccgttctcgcactccacgcccttggcgactttgaagcagatctgaacctcatcttcaattcggcgcgtcacaacacggtcctggttttgaccgccccgctttttcttcttgtttttgacgtgcttctaaggagatgtaatcaatgtcaacaggggccgaggagcgtatgagtttgaagcacgccatacgattgtttctctagccgatagtttcgacttcaagagcagactcatacatccttgcggtcccgcttgttgttgtcattagcattgttgcctccgtcgttatcgtcccctgtgcgaccctcgtcgccttgagcctcgacagcctcactcaggtgagccaaggtctcctccttctttacttccgccttgggcaccaagtactgagctttaatgggggcaattcccttgtggtaggtgggagcagctgtctcatttgtctctgagggtgctacaatggtggccgtgggtgccgcagcctcagccgcagatactgcttgattttccgccattgttggaactgtggtgtgcatgcgaatggacaagaaaaagaaaaaaaaacacaccacagacgcaaacatgtatttgatctagcagtcacaactgctgaccgatatattgcactcatgaacctgctggtgccagaccgatatatgcaagcgtctggtcgtcgggactacatgtcagcagtcttcttctttacgttaagtccaggggcgggcatgtgctatgcgaatacaccttcggcagcgtaggttgcaccattcagcataggcgcgtatcttgcttggcgaggcgaacattcggggtgagatctgaccttcggacgacgctcgaaccttggcagctggatccctgaaaggtctgaacgatcgactcctgatactgtagccactctgttggtttcacgctcaactcgaggagttgagcgcacgcattcctcacggtttgacttggccgctagagacagagttgcttttgagatggaacagccttgggcggtcgttcagcccaaacgctcacagcaattttctttgattgattgccgccaattggtctcaagcgaacaataggcgaatcacacagccttctgcagaacatggagcgccaatcattggctccccacgcgcgcggtgtctgtgcttttttttccttcttcgccctcttcttcgtccttccgcactttagagagctcgcaatacttctttcaacctcattcgtctccactcaacccccccccccccccaacctcaggattcggtctcatttccacgacagtcaggtatgcagcacgacgtttgcatcggaaacacattgcagtagcctggaacagcataaggagtcaagcactaacgtgccatgggcattgagggaaagagagacgagggagatgtcgacaatgttgcatctcccccttttagcacaaacaaaggagatgtgtcttggtaacgaatccgcactactgtttctaacttttcccaagctgcttcacctacactcttcgtcctactcgacatactttcccgtcgcccttcaatggtcaatgtgctgtgtggtcaagaagaaccataattctttctctggaaatagaagcaagcaaccatgtcgcgttatccgccgcccgggcacacgccgtatcccatgcataatgtaacggtccagttcaatccaaacgcagatccttttcaggacgatcctcaaaatgcacctctcttgactccgggctacagcaatatcagtaaccctagcagccgcaacagcaaccgaaccaacaccagcaacgactcgagccatcccgcccgctcgaaccacggcggctactcccctgcccatggcatggctcccgcaaataggccaatgccaccatatacctcctatcaacagacacccctgcacatgccggtgcccatgcctgtgccctcgccacctatccacaacccttttaattcctcacctcaatctcagccccttgtgcgctttaacatgcccacgagcccgtcaccaagtcttggaggactgattcccccctccacccctccagcggctcagccagacacccgtcattacggcccagttccgactgctcagcgtcggcggttccacaccactcgaaaagtgaagctgacgtcaggaaacctggtcctcgactgtccagtaccatccaagctcttgaagacgctcaaacatcaagagggtgaagagttcacgcacatgcgatacaccgcggcgacctgtgatccaaacgatttcgcggccgaaaggtacactctgaggcccttgattatcgatggtcagcctcgcgagacagagctgtttattgtcatgacaatgtacaatgtaagtttttgccaacttgtgaacttgaaccttaaaggtgggggatacttgaaaaatgtgaacagtagttaaagacttgtaatgttaatggcttgatgatctaggaagatgaggttctgtttactaggacgatgcatggagttatgaaaaacatacgccatttaaccactcgcgaccgctcgcggacgtggggccctgattcttggaagaaggtcgttgtctgtatcgtgtccgatggccgttcaaagatcagtccaaagactctcaatgttcttgctgcaatgggcgtgtatcaggatggagtggcaaagaatgttgttaacgataaggccgttactgcgcacatctacgaggtcagtcaacatctttaaatgtccctgcctcttcccgtgctcgaccgatatggatctgactccaaagtcgactttaatagtatacaactcaggtcacccttgatccagacatgaaccgttccggccatgacaaaggctatgtaccagttcaaattctcttctgcctcaaggagaagaatgccaagaagttaaactcccataggcaagtgagcaactcttccaacacattttgatagtcagcgatggaatgcagagccaagataccgcctcttgttctaacatgttctcttcttgcactctttcagatggtttttcaatgcctttggtcaggtcctcaagcccaacgtttgcgttctgctcgatgtcggaacccgtcctgggtcgacatccatctaccatctctggaagagtttcgacctaaactcaaatgtgggtggtgcctgtggagagatctgtgccatgttgggtcgcggaggcagccagctcctttcgcccctcgtcgcctcacagaactttgagtacaagatgtccaacatcctggacaagcctctcgagtcggtctttgggtacatttcggtcttgccaggggccttctcggcctaccgctaccgcgctctccagaatgacccctcaggtcagggtccactcgaaaagtacttcttgggcgagaagttccacggctcggatgccaacatttttacagccaacatgtatctggccgaggatcgtattctgtgcttcgagctggtcgccaagagaaacagtgcttgggttttgcagtatgtcaagtcggcttatggagagacggatgtgcctgccactgtgtcagagttcatttcacagcgacggcgttggctgaatgggtcgttctttgcctccatatatgctttgacgcacagcatggatatctggcgctcagaccactccaccgctcgaaagttgttcctgcaccttgaattcttttacagctttgtgtcactagtattttcttggtttgcgctggtaagtcgactgggcaagtgttaacagcgggggatgtggcagagttgatcgcttaaaacttacatctctatctttgaactttaggccaacttttacttgacattctacattctgagcaacgccatgatctttgtacggaatgcggacgggacagttgaacaaacgagccccttcggccaaaacaacgtcggtttttggattttcacggtgacgcggtacatctacctccttctgatcatagcccagttcataatgagcatgggaaatcgaccgcagggctccaattgggcttacaaatcctccatgggtttctttgcgctcctgatggtgtatatgctgttcggagctgtttggatgacaatcagtggtatcgacaaggcccagcaagacgccgagagagctagaagcggcgagtccatggtctctctctattttcaaaacgccatgtttcgcaacactgtcatatctctcgcctcgacctacggactttactttgtatccagcattttgttcatggacccctggcacatgttccactcctttgtccagtatctcctcatggtgccatcttacgtcaacatattgaacgtgtacgcgttctgcaacatccatgacatctcctggggcacgaaaggcgacacatcggtcgcgacggatttgggagtagccaagacaacagccgacggtgtagaagttgccgttccaacggatagtcacgatatcgacaatgcatacgacgatgcgatcgcggcgctaaaaatcaagacggtcgaggtcaagcagagtcgggacgccaagacaaaacaggaggactattatcgtgagatccgcacgcgggtgttacttgcttggatcatgagtaatgcgctgctggtcgcaatgatcacctcaaccacctttgggaacttcaagacgacgagcaccgtctacttgggagtagttctctggtcggttgcagggctggcacttttccggttcgtaggaagcgtcgtctacatggtcttgcggttgttcaatggccgcatagtgtgagcccgaaccagggcgcgaaaaataaaaaccccttatcgcccaccgacagtgataggttttaagggtttttgacacacactatttgtgatgaagccaaagtcgatctcgttgcatttcgaccatccctcaacaccagctcgccatgtcgattgcaccgccaccactgccgagcgccatcagcgccttcggagtccagaatggagctgtggatcaagtgccggctcaggaaactgaagcggtcaaggacgataccgcctcagttggcatcatttaccctccaccatacattcgaggtaagcacattccgatcaacgctagatctactctttactgatatgaaaggcccttggagctcagactaaccacgatttcactgcccttgtttgtagaaatcgccgacaagacggcagcatatgtgtcaggaagcgattcaggagcgcagctggaagagcgacttcgacagagcgaaaagaataatgcaaagttttgtttcttgaaccccacggatccataccatgcgtactacgctttcaaggtccaggaggcaaagtcaggaaatggtatcaagatctgctattctttactgtatcggatatctgtcgaactttgctaagcgacgcttagtaacattgtgtcaccttttatttttgatagctccaaaggctgcggaaatcaaggcggaggtagaggcaaaggtggaagaggccatcaaaccaccaccagaggagccaccatcacttgagtttatgacgcccatgccatccgtgtctgctcaggatctgtaagttttgctcaccttcaaagggtgggatgtttgcgtctatatagttttaactaactgttttccgccttctgttgcgtttgtgttcaaaacgaacagggacatcttgaagcttaccgcacagtttgtggcaaggaatggaaggcagttcatggtttcgctagcacagcgggaggcacgcaactaccagtttgattttctccgacccaaccacagtttgttcaactatttttcaaaactcgtggaacagtacaccaagatcctggtgcctagcccagacatgttggagcaaatcgaatcgagggcttccaacaaatatgcggtacaggatattgtcatgcgacgcgtcgaatacacggcataccaacaggaactgcgaaaaaagaaggacgagaaagaggacgccgaaagacgtatgttaccgactaccttgatcgcagcgagaatgggtttgcatgatggacttgaaactaatgccctgctcatccttctatgttgatactatagaggcatttttgagcatcaattggcaggactttgtggtggtgcagacgatcgagtttactgaggctgatgacgcacttgatttgccgctacctaagagccttaaagagctggagaccatgtctctgacccaaaagcggatgattcaagttttggcggagagtgagcagcaacctgacgcgccccaggacattgaaattgacgacgatgatgacgacgttgacatggaggattcggatgaggaagaggaacaaccacaggcagagatcaccaacgctaacgaggtcattatgacagcaccacagcacaccgcacccatgaagatcaaggaggactacgtgcccaaggccttcaagggtcgtacggctgccagcttactggaggcgactcaaacttgtcctcgctgtggtgaacaaattccagtctctcagatggatgagcacgttcgtgttgagctcttggatccccgatggaaggagcagcgcgagcaggcagaggccaagaccaaggccagtaacatgcttagcgatggcacagatgtggccaagaacttgagtttgctcaaagcacataggaccgacatctttagtgaggaagagcagagaaacgcagaggaggaaaggaaacggcagattcaaaaggaggtcaatgtgtgggatggccagactgcgactgtggccttgactgcacagaggaacgctgccgctgctgctacccgtgtgccgtacggtcaggaaccacccagaacgtcagactcgtcgattggaccccaggttggccagccaccactttatcgtcaaccagggacctataaccagacgttccgcatgcagcctggtggtcctccgcccatccctcctccaggcatgatgccgccaccaggcatgcctggtattcctccaccacatttcgggcaacagcctccaggcatgccaggtgcgcccgggttttatccaggacctcctggcaccgtcccccctcctggcttggcaccgccccctgcttccgccaatctgccaccccgcccagctcctccagccccaggcatgcctgtatcaaactcgcctgttgttccaggaatgggagccatgccagcgcaaacaccccctgctggtcgccatcccgaggaagagcattctatgcaagatcgggatgtgaagcgcttcaaatccgaacacaattcgccactgccatcatcacccgcccctcccgcctcctctgcaaacgctgtgcccactgcgggaggaagcaattggattacgttggaggtccagtttgcagacccggatgagatcaagcccgaatggaaccgtgataaggtgtctagtgtgacgattgagaacttggtcaatggaacaatgatctcgactgtgaaggaccgtatcttggcattgactggtttccccgttggaaaacagaagctgatcctgccggacggtacagtggcgaagaatcagtcgacgctgggcgattatggcttcaggatcgggcagcgcggagagttgcgccttgcggtgaagaagtgaaggagcattgcaagaaagggaaaaaacaaatacagagacatttaaagtttttgtcatcgcattaaattagcatgcgctcctcaccccaatacagtgcttggaaaggtcgttgtgcaacgcctccttttcatacaagggaatcggccattctttttctatttggtccttcattgacattcacagacgcgcacgcttgtgcacaaaaatcgtcgtttgttgacaatgtcttgtcgtttcgcgctatccttgtgttagaaattgttcgactgacatgtttgcaaaatggcgcagagacgcgtgagaaaaacagaagcgcgcggttttcctgctctcggactatgttttcctatgaccatcacgacctttcttcacttcgccttcgttgtctactaattacatcattatgaaggagccgaaaagtcaacagacaaggacgaggaaatgcgacaccccgttttttgttcaagatgtttatttacacaagcgttctttgttctttcggagatcatgagggtaagtgccctcgtttctgttgctatcgttttttttttttacatgcggttgagctgatgaggaggggcggccatgttctcggtatggccggcgagctttttgccatactcctcgaaggcaacaggatggtcggggaccttcttgtgctcatcaccatgcgcgtgtttctcttgttcgtgagccttcgattcaggagccagctggtggagggcaccgtgggtgttggtcacgtattcatttcccatggattgctgctggccatggaggagaggaacggaagtgatgtggaagggctcctttgcggccttaggttcggggtgcttctgctctttcaaagtggtggcaggggtcgactggacgtgggtctcggcttcgacgatttcgttggtcatggctgctgtgtttttgttggagaagagggagggttggaaagggaggagaaagtggtggatctggagaatatggatgtgcagaagaataaaagttgaaccgtcgtaaaaggggaatgagattcgagggttttatagctaaatcgcgtgaaaacaagagttgctcaatgcttcaggaacaggcaggtttgttctggaaccttgcactgcgagtagtgacgggaacatgcaaaggcacgcccttttacggccatgcgtgcagccgcggtgtgcatgcaaaggcgcgggggttgtctgttgaactgaaaccgtctgtgtactggcggtgcctgaaggaccaatcatcgggcgtaagcatcgttgccgcatgaagacaatcgacgctgctgtgagcaaacactggcaagtccttgttgatgatgtgaaagcgttccgatatctgactggtgcaatagccttgaacggatgggtttgcgtttttctcaaaaaaaaaaatgccaattctgagcgcattttgaaaatgctcttgtgaacccttgcaaaaattttcgtatcctgcttgctgctgcgtttatttgatgagtgctggtttgggcatgaatgtctttctcttgtttccgcgttgcttgccatacatcagttcgacatagtctggcctaggctttgttttatccatatcccccgactttttctgctgcgcttgactgctgccggttgctgttgttgtgctctccatatctctgtccatgtcctcgtcttctgacacaagatcgtcgttttccaagttctccagatccttcacagcctgtttgatgcctccgtttagctgcatcttgtaggcgagtgacgccttgggtggatgggcggcagcagaggatgtcttcttggcaatggtggggttggctgtagcggagagaacgtcctttttaaaaccacctttccgtccctcagaagtggcagcatcaaataaactggtctcggcaccccctttgctcaatgagagcacggccttctccttgcgagttggtctcttgaaaaacttggctgactttcccattgtgtgtgtgtgtgtgtgaggtgtgtgatgtacaacgacaaaccagccagctcatgccactcaaaaaaaaaaaaaaaagcaaaatacgtgactgcttcgccctgtgcctggcaccgtgcggcgcacgttgatatctggcatgcttataccgcttacccggcactttctgctgagagaccggcggagctagttattctgcatcttttactggcgagcccatgcatccatgaagggctatgttgggcaagtggttgccgcggctctggtgcccgaaaaagttggcatgtcgacctgtctgtgactgttaacatcgctgaatgacgcgcatgttgcatatgtatgtatgcgtgaggcttctcattcttctcccccgatcagctattgctcactactaccgctcagcatgggaacctttgtaacagacaagttgcaacaactgaacaatgaccttgtgcagctctttcagctcgatgcccaggcgctgcacggggacaaccaccaccaccgcaccaccgcacccactccgcccaacagcagctccaaccctcaggacactctgtcggagcagtcggacctagcactagcctcgggactacgcacatcgatcgaggcactcgactttcgctccggatcggtcccccccatggaacgcgtctttctcgagattgaaaaagttgagactctactctcgactggatctcgaggcggacgacagacctcgaccatggagcacctgtttgtagcaaagtgcacggtggccgtgtacctgaacctgttggatataattctaaacgcgacattgcctctgtcgaacgagattgaatattggcaatcccttcgtgatagtccgacctggagacttttgtacattgtgcagagtgagtgttcgattttcacagggtcattttcgttgcagaaaagttgaagaccatcactgttcacctcgctgatacaaatacttcttttctatcttatacatctagcatcacctcaccggattatctctttgaccagatcggtcgtcgtctcaacgcgggatcacctcgattcgctcatcgacacagctgaagacaaggaacgcaggacgcgcctcctgaaaatgattcagtactttccagagtttctcaagaagcacttgatctcacaacccgtctccttcccagtcgctattcactacgaaatcagcagccaccgtaaacagctccagcggatcaaagagtaccaggcagagtgtcttggacttttggctgagcaaggtctcaacctgaatgctgaacatctagagggctcgaccttgggctctccctcttcttcctcgtcaggctccttttcattcgcgggcgagaacactcagagggccgaaaagtttgtccagggccaaatttccaaaactgtgtgccttatggagcgagtgctcgacaaggcatccaaggacacacaccaccttgcagaccctcagcaacaaaaagtaccttccagaaatgcagctcgatctctgactatgctgggcgatctgcatggcgtatccagcctagacagcaacgaaacactagagcatttgaaggacctcgtccaaatccagatcccgcgctatattgaggaaactgaaaagcaagcagaaaaattccatcgtccgtcgtggctcactcgaatctggattccagccctgattggatatttcaccttaaagtacggtcttcgatacgtgagcgagcaccgtgcggatctggacgaatttctggaagaggcatgggacactgccaaacgattcgtgacggactgggtttgggagccctctatgagggtcatggccattattcgacatagcgatgatcaagggtcgcttcagatgcttgggaacgaaagcctcaagtctgatattgcggtaagcccatggacacccaaggcttgactctaagcgcttcgtttatactgcaggccttctaatgccctattctacattattgtaatgatgatttagagtttggagcgtatggtgcttgactttgggaaggaacactatcggatgggacaggaagatctcgcagcactttcgcaggccgtgcacaatggtgacatctcagtcgtgatgcgagcatacgaacatgagctcaaggtatgccactggatcccaaagatcacggcatggactttcttttttttcgtttagcttcacgttccagttcctgactttttctaactcactacttttgcgaatgtagaccccactaaagggtgcgatcgccggtcacttggtgcagacgctcttgatccaggtccaaaagacaaaagtcgatgtcgaggttgcgatggcagcccttgacaagctgctcaaggcgaatgagctcaattttgccttcctcgccgttggacccagtttgctgctcctttgggcagtctcagcacaggccaagagctcctggcagaagatggctggccgtaatctgggtgtggtttcccttcagatgaagaattccttgcggcaggtggagaagctgttgaacttggcgtcctcagagtgtgatggacactcgaacgcacaggagagccacggtggacgagtgaggccacacggcggtaatggtcaaggaacagaaggaggattgttggaggaatacgatgacttgtcgtcctcgagtgcaactacaccgtcggctgaggagccattgtccaactcgttacagctcactgcggagagactgaccaggatgagagcgaagaagggcaaggttccttataggactcagggcttgatcctgtgcgaagttcacttgctgaggacgtttgctgcgcgactgaccagagcagatagtttgcgggacaaagtcatggaggatttgcgcgagattgaagagagctcgctcacggtgcatcagcgattgagaacaaccagtcgcatgtaccgtacatatggattcttgggtttgcatcactgaacagcagcagcatcgtttacgttgggacaacgcaataaacctcttcgatgaaaaaagaataaaaaaacctggtttattactgcagtattttgatccgcaattcaatccaagatccttgttgcgaacgactccagagaggctgagcgcttgtctcccgctagcggtgacggatccgatgagagtgacttctattgggccagtgaaaagaacgacctgtcaatagtctgcttacaaaagaaggatgaagaagcgtttatgtatagtcgtagagtgacatcccccttcaacgtaaacgtccctaaactcaccacatttcccatcattttccgcttgagttcaactagacaaatgtaaaggtaaaaaaataacgcttagccactgtggcaatgacaacgtatacgaatgaacattgaccagatttgtatcttaccaaactgatcgtcgctcaaaggtccaaacttgatagagttgttggccggataattgtcatataggtttgattctgtgatagacagctgtgcccgctgctgtgccaactttgcgaaaatggtattctcattccgatacctatagccgagacaatttctccattggtaaattcctcttgactccacaatatcctgtgcggaacgtaaataacggtgatgatgtatacgacttacattcgaagcgcctccttgttcactgcctgtttctcgacaatcgtgtccagaacacactttttgaatgcggccttcacataatggagcacatggaacaagtaatcgcggtggggtcgccactgcgggaattgatattggagcgccagctggccgtttgcatcgatcagagggtgccacatgtcactcaagaagtggacggtgggtcttcgatcaggatactcgggcggaatcaccagtttgaatttgaaaactgcgttgcggtagtagcccttgtggacaaacaatgtaccgaaccacactggtttttgaaacgtccatgttacaagaacgaaaaaaaggcgagcgttagtatggcgctaacacgcgatagcattcttggtcaacgtgccagggtcaggtctcgcgcgggaaacacatgtgtcatctctcttcctccaactctccccctcgtttgtctctcttttcctgggcagcgagcacatcagatgcgctgcagaaatagcatagcgcagtgcaaatacgtacgattcatgttatcggcagcgggcatcacatagacccccgaggggcaatgatgcggattccgaaggttggtactaagcacggcaggaatacaggagacaaacgcgcggaggagcagcgagaaggcaaggttagttgcatcccgtggcacaggttgctggtgacacaccgaaaggactggtcaagcacctacaactctatcataagctcgtatcgtctgaagaagtctgaaaagagctgtggccgtgccgctactgagggtcgtgccgcgacatgccgttgctggtttggtgatgagagatgatcctgatggtgtattgaatcgggatgctggttctgaggattgtatgacaaggttgccgacgagggctgatgacctgccatggggtgttgcgcatgcaattgctgctgattatgctgctgctgctgagactgagggtgggactggaagaggctaagtgcagggccgccagcgacggtgctgcccgacctggatcttgtctggaagatgctcatggctggctgtggggcactggggtattgatggcgtttgcgtggagggcagagtgtgatgacaggcgagaactagggtgtgcaaagtgtgcctgacaggtgatagccgtgggctctttgctatcggcttatagttatgggcgtctcggatgccactggcaatcacagcagagagggtggggcagcaagagacgacacggacagatgaacaggacgaagagcgagttgcgagatgcgaagacagcaagaacgggaaaggagacacgcaaggaggcgcgtgaatttatctttcttttttaccctcacgcgctggacgcatcacccttccaccagcttgtctgaccctttgagcttgtccaataccccgctccatgccggtgcgctgatcgactacgatgtctgaaccaagcttctctaaaggtatcacgagtcgacgcgtgctcttttcatctgttacggtattcctttagtactacttctcgaccctggccccgtttttcgtcgaaggtgatgtcatagagctgggtcacggatccagtgagtgctgagcgccacggtcttctgagaggttttgcccaatggtcatttaaggaacactacagcttgacccaggaactggagaacagacgtagtgggcccttggacccctttccgacagtctgccacaaaagcagcttgcctcacttgcaacatatagcgatataatctgaacaagatatggatagtacatgttcctgcttccggccagcacttcaaccgttctccgctctgggtcgcctccatgtccatatggcgctggagaactaaaggaccaatcatgcaaatatttaaagttttgctttcgcccagggcacaagttgagggtgatgaacgtcgaagtgatttcaagtcctgagcaaagatagactgctgcctcccgcacgccgctggatgacgcctgccttccttgcagccattgatgaaatcgatctacgtagcgcggtggtccacagcacctgtcgcacccacaataaatttctctcctcatgtggcccgcgagttcctgtgaaaatttggcgcctgatataatggaaacatcgtgctttcgagtgtcttcggagtatcacaattggaacgcttaaagatgctcgggctatgacaaaggtgaatgtaaaactgttcactgccaacacagcagtcgaaaatcatggagctcattgttatacatgctgttgttcatctacaaatcccacgcgcttctgaccttccttgcgctcccttatgtcgctgatctgctcctccgcactatcttctggatccgccttgtattctctcgcaaagcgctcaagatcctcatgacggtcatcgctatccaaataccgttcctgtacgtcctgaacataattgttccactctgacccttcccgcatcgccgtcataaaaatgctctcgttcgcttgctccagacctccaaagacatagcccccagccttgtcgatagcacggaccacctttgtgacagagtctttgtcctggatgcagagcgtctcgaatccaaccaatccaaaatcctcgatcaagctgcacatggcctcattgagctgttgaaatcgcttcatgaacggatcctgattcaaatggtactgcaaaaaactcaggtcctgaacgttggtgtaaaagtcgagggacatgggtaaccgtccgtaggtctcgatcaagtcgattttggagagtacgttcacatgtggcaactctagttggagcatggtcttgagcgacagtaacagtacagagatgaatttggcggcatccgtgcaataatgtgcatcgaccaaatgtacgcaacacagctatggcgaaacgaggtatattctgcggattagtcattggtccagaaaatagcccgaggtcgaatttcgtcatctcctcgatcaggttcatctcactgaataatgtcacttactcgataaccaatcttctcgagcctatttaggatccgcttcatggcatcattgtgtgtgtagagctccacctgtcccgggcagtcaaagacaatatagtcgtctccgcaagccttcagcttttcctcaagccagtccatgttgtctgcgagatattccatgcagtaaatgatgccgccattcggtccaagctggagattctccatggtgtcctcgagtgagatcagttccagaatcgagatgtcggtcgggtatggcagtgtctcgttcgctgggtcgaggttgacgatcgttgtctttctaacaaagtaatacaagggcagaacgtcaggagagaaaaaaccttgcgtgggctactcaggctgataaggcatttcttggtaaatgctcctccctctgcttcagactgacctttccatgccgttcagaaactggtacattccattgcaatatgtggtcttgcccgatcctggaggaccgattactacctaacattgcgcagcatgaagggcataagtcgcgcaattcaacaaagctcctgctgcaccttgaacgattactaccaagaagctgctgtcctgcgtcggctgaaatgctgaaaaaatacctgtgcgaaaggcatattcttgctcgtgctgtcgcggctttcctgtctttatcctcggtcggtgttcgtggaaagaagcgaagttcgacaaactgatccgatgtcagaatgtctgggcaaaaccttttgacgcacgtgactctccatgtgtggtattcggggtttgagggggtgccgcggattcgtgagagggagagggaagtccgctcatggtggtgaactcgtctcgcgtactcttgctcataggggttctcgatagtagtgtttttctcagatagtagtgtggtccttctagtaaagtgttctctgtgcagagctcaagatggttgataagaaggcaaccttctcttgctcccacaggatctaaactactttatagtacgcctaaattaagggtgccgccctacggcaccacacatgctggatcagctccgatcggcgcgctctgaccgcctccccctttccaccttttctctcgattctcctcactttccctcccactctcacgcccactcacttctctcgccatcgccctaattctgcagccttgtccaccgtagctcatatcttctcaaagtagccgaacatcgaccacagctaagcctaccagcaggacgcgtaccatgcacagtcagcatcctgccgccctctcaagagcagagcttggggactcgaaccctagtctgtcccctaatgatacagaaaccacgactcttcttggtggccagccatcaggaaccaaacgacagggagacaagaggcctctttccgcagactcgagaaagaagatcatctacactttaatgtccatatctgccgtgttactcgtcgccttggctatcacgctagtgtcaaagctgggcgctcctcctggtaagcctggaccgccgtcctgtgtggctgttaaagctgctgtggagcgctattgaggcgtaaccccttgatttttttcgtgactgaaccataatgctagtgttggtaacatcgatctctcctgtccacttgacaaattcttctgtgttccttgtcaagcgatcgagaagaatatacctatactcatcaaggccaagaatggtgccgtcgctgctgaggagattcattgctcagagattggggtggaaggtgagtgaacacagagaaaaatgtgtgccttatgcgagtcgtcgtactttataccttcattgccttcctccaccccctgaattttccaacactgtaaaagaagaaaaaattcgtgtccccattgcacacaatatgccgtactcaaatattcttcgatttgtcctaccttcaatgacacaccctagtcttaagagagggcggaaacgcagtcgatgctgccattgcttcctgtctttgtatcggcactgtcaacgcgtttgcagcgggtattgggggcggcggcttcatggccattcggctgcccaacggcaccgtggagatgattgatttccgtgagacggcacccgcggcctcgttccctaccatgttcaagaaggatcctgttcttgcgcaacggggtggactagcagttgcggtcccgggcgagatccgtggattagagttggcccacaagcggtacggcaagttgtcgtgggaacgactttttgagccatctgtcaagctggctagagaaggctgggctgtcggtcccgagctggcgcgaaggatctcgttggtcaaggacatgatggagaccaatcctgattggtctcatgtctatgcgtccaagaaaggcgtcgcgctcaaagagggagactggatcaagcgagaggcacttgcagctacactggagactgtgggaaggaagggggccgatgcattttatgagggccagatcgcaaaggacattgtggatcatgtgagaagaaacggaggggtactctccatggacgatatgagaaagtataccgcgttgatcaagaagcccgtggtcggatattaccaaggaaggaaggtctatgcagcaccagctcctgcaagtggccctgttctcatcagcattctgaacatcctggagcgttacaacgtgggcaagtcagcgagtacagcggacctggacactcatcatctggtcgaagctatgaaatgtaagtctgttttttttcgggtagcatccagttagtgcttgggtagcatccagtcaatgcctcacgcgaaaatcgtcagcttacactgctcacgcgtttgcatcaacactacacaaactagttggctttgcgcaaagaacagagcttggtgaccctgactttacagacctcaaggaaacgatccgctccatgatctccaaggacaccgcctcacagatccgcgccaacatttcggacactcgcacattcccggtcgaatactacaatcctcattggggcccgattgacaaccatgggacaacccacctttcgactgtggacaaggacgacatggcggtgtctttgacatcgaccgtgaatctgctgtttggctccaagctgctggaccccaaaacaggcgtgatcttgaatgacgagatggatgatttctcgatccctggtcgtgccaacgcgtttggcttgcagccctccccgttcaactaccctgagccgggcaagcgacccttgtcgtcctgtgtaccgaccattgttgaacgagatggcaagtttgagatgtcacttggaggaagtggaggttcaagaatcacgaccgctgtgcttcaggtaaagcagttgcgtagagaggtgtatctttacgaaacgatttatattgtctcttttttcttgttttcttattggctaaaacgcccgtgggcctttttttttttcttctttggatagaccatgctcaatgtctataaccacggccagaacatcatggaagctatcgagaacccacggattcaccaccagctgatgccgaatgtggcggatattgagaagggatatgctcggtctgagatccaattcttgaggtctgctgggcacaatgtcacgctgtttgatcgagtggaagccaaggcagaaatccaggcggtgatgcgggatgtcgatgggtacatctatgcctcgagtgacactaggaagcaacgagctgttgctgctgggttctgagtaatgttctcgcttccagctccctgaaagcgtagcgcaatgtttgctaagatagggcatcctctacggtcgactgtaaataaacacatcgagaatgaaagcacacacacaaccccctccacacctctacaagctcaatacattatgaagggccacagagacgtgcaaaagcctaggatggtgaatctgagtgaacatgtgtcaccactctggccacgcgaaggcaatttttcttttgcgcgcggttatgcatggcatggtcgtttgtcaaagacatgcatgcatatgtccgtttttttttattgctttttgcgcggagtgcggtgtgcttgccagcgaccgcgacccgcgcatccgcccatgcgttgcggctgtttgtggccgccactggtgtctcgatgtggtcagcagacgggcggtgtgcacaggcagcgtagagtttggtgggggactcacgacgaaggggggtgtgtgcgtgcacacaacagcgtcccttttgaccacaatcagtcccccccagagaaaaaaaaatcaacgttgcgacggcacctgtccctcttgcctctaccattgccctgcacactcctcgtctgattcacacccatcctcctcctcctcctcctcctcctcctcctcctccatctcctccatctccatctcccacggactgtaacaccccacaccacgcagccctgccgtgtcttgctgaccccgacacaccgcgatggacaaacccatccctggcgacaagtatgtccgcactctctcgcactaccttcgctccaaccagcgtcgtctactcgtgccgtccgcctcgcccaacggcaccagtcgcaataactctagcagcaccaacactaagaacaataacaaccagaacggtactggacccacctcaccagaatacgccagctttggctcctctgccgctgctgcaaacgcccgctccttcgtaacgccggcagactccatggccgccgcctactcgggcatggtgtcgtcgctgtggaatgtcacctcctcggtcgttagcaccatcacaccatcgtccttgctgccgtcagaggggttcctctcttcgtcggcgctggaccgcgacgcctacactggggcgtgggacggaacaggcgccgtcctcgcggactcgagtccaaaggaactccagcttcatctgtcggcgcagctgcgctcgcccgtcttcccgctcgacctttactatctcctctacttgctcgaacggttcgagcaggtcggcatcgagcttgagggctgggatgggatatctccaaggactgtggggacgtccaccccgcgcaagggcctgccaaacaccaccactcacgcctcgttccctccggcggcagggcctccagcaacctcgcccgaccgaccccagtccattcgctcgttctcgtccacagccctttcgaccctcaccttgatcacgggctggaagcagtggtccacagcagcctcgttgaactcgagcaacctgaccatcacagacgacatccattttatccacaagtttctgcggcatgtgcccactcttcggctggtggccaagattccaccggggaataacaggcagctccagggaaagggcaggatcgagggcttcagtgcagacaccatgctcagcatgttcaaccaccggcagtcgatgcatatggatctagacgagcccctgagcaagagcccctcgctgctcttattgccactcgctgccacgttccctgcgctcactcatttggagctgcacaagatcccagcagagtgcgtggagggatgggagacgctgatgccacagctaaagtccttggttgtgagtcagtcgggcatcgaggacgtgcacgatgtcttggtcacagcggtcgtcaacagcgagcggaggcggcggcaaaggatctctcgggacaagaatagagctgtgatgatcaaggaggagcaacaggaggcactgaaggacgcctcgatcgccgctcaaggatctgaaagcgccaacgctgatacactagaggattcaacatccagcagacaaaagtcacagacacaaggcgacaccccagtcgagcagcaggatgaggcgtttattttggcctctctgaagatgtggccagtgctacgacatctgtcgttgtccgacaactcccttccggatttgacacgcaatgacacgttcatgtatacaccgtcgatcgtcagcctggatctgtcacataacctccttctgtcaccaccctcgggcctaatccacctgcacaatttgagccatctgaacctgtcgtacaacatgatctcgggcgtgcaatccatctaccaaattctgggcaatattgcgacactcaacctacgcggaaaccgactcgagagcctctcgggactggagagactgtggaatctggagatggttgatgtccgtgaaaaccacctgggcgaggctgccgaagtcggccgactggctgcccttccaggaattcgtgaggtttggtcggaaggcaacccgttctgcgctattcaggtacaaatgacagcttagtctcgcttttcgcttgccatatgaaggggggtaggaaatacgagacatgatgctgactaggctttggcatctttttgataaccggttcactcactagcccaagcatcgacttcagatcctggcagtcttcaaggccaatggacacgatttgctgttggatggcacgtttgcgtccttcactgagaaacgagttttggccaacatgagcccatcctcgttctccaccaccatttctagcatcaacaacgtggccaatatacccgctgcctcggcaccagtcgctacgtttgcaaaggagatgtctcacgatcaccgacctgtccgacctgtttccgccatcgtgacagaggatggtctcagtgcggcagccgtgcttggagcaggggcttctgttcagtcacccgtcaacaagctagtcaggaaaaagctcatgaagtcaaacaaaagggtcaagagggttgtcaatctggacagcgaccacgaggatgagcccatggccgctgcggataacgatgtcaaggcattggagggcatgttcagcgatgatgacggtggtgctgtgcatggctctgatgtgattccagattctcccgagctggcagttaagaagagaaagaagaagaaggctggcagaccagtgcgctcgccaaatgaggatgtggagtccatgcaggaagtaactggaaacaacaggcatgccgacgttgatgctgcaaaggacaaggagaagccgcgggacaggcccaagaaacgcgcaccaaagaagaaagacactgggttggcgaccgtcagttttgccagtgatgagcaggatccgactgttgaccattcgctgtgtcgcaacgatcaccatgtacaccgtcaccgattggcccatctcgaaaagtccattgcttcgatccagctggaacgctcgaattctatggttccaggaggcgtaggggctggatcgcctttgggccaccagcgtcaaccatcccgagggatactgaagaaagccccgacgatgccgctgcccagcggtgctatctcacccaggctgcgaccctcatccccgatcggttcgttttcgtcggatgatggaggagccgatggatataggcggaggattgaacagatgcgaaacgaggccggcacaaactggctgatggttcttgcagagatggacggcagctcgtcctcgcgaacagaaaatgcatcgtgaagtaaaataaggttggtggcaaaactcaacaagccacgtccaagcaccatcaaaaccttgtcctatttttttttttttttttgcgttggtcctccctcattgcagtgcacgctactttttcaccgatgagctcctttgatcaagtcaactctacattcctcgcatggctcgaggccaatggggcaactgtctcaaagtcaatcacgcttcaggactactctgcggagggtgccggacgaggcgttgtagctgtggctgatattaacgtgcgtgctggaccttgtccttctgattctctacatcactgtcgtcatgcgcaacttgaccggatacgggaaacactaacaacatccactgtttcttgttttctttttgatattgggcggatcttccacagaaggatgaagagcttttttcaatccctcgccctttgctgctctcgcccgagacctcggctcttgcacaaaagatcgatctcacggacctggagggttggaacccactgatgatgtgcatgatctatgagtactgccgcggaggagactctcactggaagccatactttggtaagagaggagaaatcgctcggctggaaccgcatgggcaccgatgtgtctgaactgatcacgaaatttattttggcggtgaattcaaccaccagatatacttcctatggaattttcaacgcccatgttctggaacgcggaggaattgcaagaacttgctggcactggagtcatgggtaacagttcttcgactttttgattgatcaatgctgacagtttatgccctcttggaaaaagttttgaccgctgaacatctcctttatgatctattttaccttcgttcaaatattgcaaactatacttgttacagacaagattggcaaggatgaagccgagtccatctttgctgaaaagctgtggcctttgatcagcagccatgcggaactgtttccagtcaaggatcaggacgaagcggcgtttttaaagatttttcataggatgggttctttgatcatggcctacgcatttcatgataccttgcccggccaagacgaggatgaggacatggaggacgacgaggatgacgaggatgaggaagaggagaaggtcacggtgtccatggttcctatggccgacatgctcaaccacaaaactggtttcaataacgtatgggcactactgggcaacttgccatggctctcgatttggatgaccgtcgtatcagtgtcctaactttacttggttttgtcgaaatggctgtaggcaaggctgttccacgagaaggactgcctgagaatggtggcgatcaagtcaatcaagagtggtcaacagattgtatgtccatacgatatatgttacagttggggcaaagtcttgacggcgctgcctcagtgatactaacatgcgcgatctttgcattctgaaatcctttccttgcgtagtacaatacctatggagatctatgcaatgcaggcaagtggacatggcgtagagcaatattcataactgtaatacgtgcttcgccatcttttcttcctagggaggatttctaacaccagcttctcccttctgctgataaatagatcttctgagaaaatatggattcgtggatgtgcccaaccctcataacattgccgaaatcagtggtgaatctgttgtggccaagtgcaccgttggagaggataaggacaaggatgagaaggtcgaatggttgctggaacatgatggactggaagagtaagacgatcgggcggggaactgcagttcttcattttgtttcgacgttctattattgtaggctggcccaactacctttcccttctcaatcattcttgctgaccgacttattttctctgattacgttaatagctttttcatcctggaggcgggagacgagatccctgaggagttgattggatgtgtcaagatcttgatgatgcccatcgacgagttcaggacaacggttgtagaaggaaagaagctgcctagcacaaaactcacgctcgaggtccaaaaggtcttgagggagctattggaaaccaaaattgctgaatatgcatccaacgccaaggtatgttttgctctagaaggactgagtgatacctcatagacagagaacactcttgattgtgcataaacagtgcgcccgcgattaactttcaattttcaaatcatactaataggacgataaggcacttctgaaacaatctcaggacagtcaaccgcaacatagaaggaatgctgccattgtgcgctctggtgagcgtgacattgtgcagagtgtgctggacaaggtaaagaagtggaaacccccagtacctgctcctgcgttatcctcgacaggcaaacagaagggcaatgcaaagggacagcatgccaacaagggcaagaagccctaccaaaagaagtagagccgtgtcgagtatcattatctagaccgaaaaaaaaacagcataaacaacacgcaagtgtgcacgccatcttgagatctcaagaacgaaaggaaaggacgatgtttcctcaatagtttcatgtcgtggtgaggaagattgaggaccactcggtagttcacaatgctggaggtgaaccacaagcaagagtttcgcagcagcttagcgctgtagttcatgatggatgtgacagagtggttgtcgtatgacgagattgtttacaaggagaatatagcggggtagagtggatttggctccgggaaagttctggagggcatttcagtgagacgaactttggcaatgcagttgtcaaaattgcagatctatgaacgaactgcatctgaatctcttacaaaagtgttccatggtactattataatcgcggccacgcacgcgcgcctgccttggagtttagtgtattttctacttttctttgatagccaaagaagcacgcgtacaggtcaacactggcgggactaactaaagatctagacgtcccccgtttgtcgttttagacgccagccggtacgaagtctgtggtcaattccatgtaggttaagacagtgaggactggcgataacttatgacgagattggccgcttatgagaagcagtgaaaagcacaatattctccatttaaatcgctcagtcacatcgccgcaggaagtgggggtggagcggagcccatgggcctgactggactggccatcgccatgcgtggaccgttggaagataatactactagaagtatcaggcaggaccaaaatagcctgcgtgagaggcttgagggtgtcatggactttgagagttgatttcgcatgaaaagggtggatgtgtaaaggctggacgcagaaagaataaaggtttttaactttttgagtcaagagcggtatctatgcctcaattcaacgccatgatcagaagtgagcacaacaaaaaaaagtgggagatcaaaaaggggttcgagcattccttgaaaagatagaaacataaactcatcccctgcactatacaaccacgatcgaggtggggaggtctatgtaggcaagcaacgcagccatttgacttattgatacatttggagtactccagacgcaactcaggcgctacagggctgttcgttttatttttggttgtgttctcgcccataatgtatcagcttgcgacgaaaggagcgcaaggaaactaaatagagtaataacaaagacattgtactcaggactcaggacttacctcgaaagaagggtctgttggcactgaccatcgacctgaggtcaatgccccgctgttgtgaataactttcgccgcaggatgacaaaagataaggtctcgcaggacgccgtggtctctgccaagattatgaatgcaatccagtgtcatcaacaaaggtgctctcgcaattgacgtctgtttgtggcgttgtgcgaccgttctcgttcaatttccgatacacttggctggctgagcacatcccacggacaagagtgctttgtggcaacacgccgtcgctttgaaataagatttccccgcagcagtcgcagtcgtttttcactgccaaatcggggtctcaatgggctgtacctgtcaattgagaatgttgccctcgagatcacatataaaaggaagagcaatcaagacaacgccccattattgaacagcgcctccttccaactttacaaccttaacttgagcaacagcatcagcaacagcatcagcatcagcatcagcagccgacatcctcacataaagtacatgcttacgacgaccgcacacgcgcctcacatcaccacttcatcaaccgtgtccaagaaaactcccatcatcgtcgttcgccgcatcgcactcgtcgcggagcccaagcaaaagcccggctccctttctagcacatcccataacaacaaccttgacaatgtcggatatcgccagcatgcttctgcccactctgtggcttcgagctcatgcagcagcatcagcagtcggagcgcaggcaagggccttgcttcttcacgaaggagcagcgtgacgaatcttgaattgcactcgtccttgaaccgccagcgaatgcaccacaccgaccaccagaaccgcgtttactacaccagtgatcttcctcgtggtcgcccttcttcgacctcgagctgccactcttcaagcagctccctttccaagaccttgaccacctcaaccatgtcatcctcttcctcggactcctcgtgcagcactgagaaaagtgacagcgtcgaactaaagagcaagtccaagttccgatcattgggcaagaagatccatcgcattctctccaggtcgtcgtgaacaacatcaatcgccaccgacgtctatcatctctgcaccatccagcgcaaccgcgccttcaatacctcgcctccaaccagttctggacaaggaacaggcgaccatcctctgctgtgcctcgtttgagccccactatgctcagccagagcaacatgcgccaccgctaattccgatctgcaagcctacaacgctcacctggagcaacatggctacctccctcgtatctcgacatcctgcaatgagcaagcgcgaagagaacgccagatcacagcgactacgtagatcaactagcaaataaatgtaaatcacgcctcttcggctcccaattgttctttagagtttcttacatctctcagaagccgtgctggcgcaccttttcatgtgaaagagggctttcggccgaggggtccactcgaactgtaaatttcccatttgtctcgctttctccactgttcctgactctttttttctccactctccactcaattcttctccctccactcgactccactcttctccgctcttctctaccctcgtctgtagctctctttgttaacactctgcccttttttgccctttgctcgcccgtctcgccactatgccgccatccaccatgaacaagattctcatgcgcatgcccgcacccatgctgcagcacgccgccaatctcatctccttctactttcaacacgtccgtccacatcaggccatggtccgcaagcacctccgccgcctcatcctcctcgtctttctcctcaacttcaaatccctgccaggcgtcttccacgccaagatgggtctgcgtatcgctgccgtccaactctactcgttccgccacggcaagggcttcaggatcaagcccacagacaccagcattgttcgtgagcgtgtctgggtcgatgaccttgatctgaactttcacttttccaacaggtaacttgttgtttttgtcttaaaaaaatccttttgttggcaagagaataggtgaaggattcatacctaacctctcatactctcgatctctcctctcgcacttacccccagctcatacggcaagaactgcgactatgcgcgtgtcaagtacgtgacctcgcttttgggcccaagcgtcttgccattacaccctatgcgccggatcgcctttgctctgggcgggaaccagatgtggttcaagaaggagatcaccctcttccagtcctacgagatcaggacccgcctcttgacctggaaccagaagtggttcgtgatcgagcaccgcatgtacacgcctgcctcctccaagaatggcggaaagcagaccctgtgtgcgatcgggatctccaagtttgtgctcaaatacgcaggcggatcatggaagaacaagaccatcccgttcttggaggcactggagatggttggacacgatgtgaccgagttgcgtgcgttggaggaaagctcagaaaacggaaatgtggttctctggcccaaggaggagctcgagttcaggtcctttaatggttggacaggtcgcgcagcagctgttggaaacgcactggagctgtgtgagacgatgctgcttcaggactgaaggtgccataacatgatagcgcgtcgctagtagtaggagttgtacagcaaaaaaacatacattagactttttttttttttcataacagtttactagccgaaggataggctgaaaggttccagactatagaataactagacgaagaaaggtccccgctgccacgtagtggcggctatcagcaactaaaccttcggaagtcacgtcccccatgtcagtcgtgatacccacgtaaccgtaggccggggatcctatccctggtggtgttgtcgcctgtaaacatagcaactgctgtctggctggctgcgaccaggttttggggggcgtatcttggtgctggcactgggataggcacttgcgaaggggcgcacctatgagcattatttgggtcctgctcaaaagagagaaaaatactccatctgaatctctttcttctctgtctttgccattcctctccacctcctccactccctcatcctcactctcagccataacgacatcgagcacaatgagatccactggagaagcaggagtagcagaaacagcatctggtatctctcgcccttgggatgattcaccagctgcagcggtagcgatggtagcagcgatctctcgtgctggcctggtctcgttcacttccacgacttgaccttgggcttcgcgaagtttttgacgaacagctctgttatcaataagcagttcctcatcggtaagttcctcctccggggtcgcaatacaagggggcagctcctgctcatcctgctcctgcgtctgttcttgctcttgctaccacccttgtgggggctcttgctggtgctgttgttcctggtcgactaatacggctgcaggtgcctcttcttccacacatagatggagacaggttactgtataccacgcccgcattcacgtggaatctcgtcgaactgggcagaaaagtgccaaaaattgagggttgcgcgtagggttggtggcgctcatatgggctgcgctcccggtcaatgggggttaaggacgctgaaattcgtgacaaagactgtcgcggggatctgggggtcgagcaaagtgaggtcacggggtaacagacgtcaaagggagcaagggacggtcaaaagggaaacagaggtcaaacagcgtagacagtcaaaagggaagcaatggggtcaacagggtaacagagtcaagtcaaatagaaagcagttgggatctcagtccattctgatccgaggttcattcagttgctgacaagggctatttaagtcggctacagtgaggggcagaaggatctagaagggtggcaagggctgctgactaattgaagtagctagaatagcgccggctcggcaggcagaggacagtgcgctgaggaaacgtctagaaacgaaaggacgtgagggcatgggcgtgggatgggctaagctactacggaaagtgggggaataagtggaagtcaggtgatagtgacaggaagtaagggagggtgggagataagcaacgtgacgtaggtaaaagacggtcacggttacttgaactgcgtgaggggttgacatcccccgcggaaaggagaagcgtcgtcctcgacgctcaactcttgcttcattcgcgtgtcttcgccgggcatcttgagcagccggtggtcctttgatctccttcacggttctggctacgctcgggaccaaaaaccggggcctcttgggcttgatttggacgggtacggggcgtaattcagcaaagatacttgaaccgtgagcgcattttgaaaaatcaagggccaaaaatttgaaaccaggatcttttgcaggcaaatccgtcgtttcacagacagcctctcgcaaggactcttggggctcgaagacatgctcctggggcagctcatctctcaaatccacaaagtctggggtgccatcatcagtatcggcataaagatccacaatctcgttaaagtcatcctcagaaacggcaagggcaaaatcggcaacaggttccggcgggcatagacagacaggatcctcagggcataggacagcaaaatccttggttacatggtcttcggtcgcatgcttgacacggtgctttcgggtgctacgttggcaccggttctcagctcggtacatgcgttcaacctctcgggccaggtcaaacgtttcttgaaggggcagcggctctctcagcaggatctcgtcgcgcacgatatcgttgacggcctcaatgaacaaggagcacttgagcgactcgtcttgaataccagcatagtcaaacaggttggacatttgtgttatgcaggtctcgatactctcatgatcagcttggcggtagcgctcggctgcctgtaaggcatcctgcattaacaccaactggtaatgcttgcgaaacgcctcctcgaaggccaagaaactcatacgtttggatacaatgggcatgaacaatgctcgtgctgtctcatgcatagacatcagggccaagacagcagcaaacttgtcgctccaaccactgagagcggactcggtcttgaacgcatccagccagctcagagggtcatcgcctggctggaaaaatgggcacttctcgttgctttctcgatcacgtaagagacggtacgtgatctccggcagataatactggtagaaagcttcctcgaagatcttgaaactcatacgctcgcgcactacaggcataaagtgcgctcgtgcagtctcgtgcatacacaccatggccagaaaaacagcaaccttgctgttccagccactgagacgggactcggtcttgaacgcttccaaccagtccagagggtcatcgcctggctggaagaatggcaacggacggtcttcagtcatggttctcggtcggtcaatcgggttataatcttgttctccgagtggcacacagtcttgttggcgatccctgcaatgagcaccagaagacatgagggtgggcgagccctcccggttgtcgtaaggcgccgaaaaaaagcttcccctcgctatcgtgggttcgacaacctgggcgttgaaatctttttttttttatttaaaaaaaaaaaaggccgctgagatgaagtaatgtccctatcttaaagcaacccgccattccatcacttttgcttgcacatcccatgacatggcacccatctttgaggtaatgcagttctcccccacgggtgcaggacggagcccagacctgcattcaccagtggaaggccactatggacgaaatacaacgtagccatcagcgatgcaagttctaacgtggtctttgtgaacataggtttgcttagatagcgtggcatcggccattatcgcaggtatcaatctcctgtcgatctccccttgattgtgacagtgtgccatgcaacccacatccgctcttccagaatatttgcttcaccattaacggctcactatcttcaaactcctcttttgtggcctcagaacaaacaggaggcgcacgaattgaactgtgtgcgggattgatggaggggggtatcacaccctcttacggtaagacggttgactgcagtggccacaggtgggttggtctagaatcctcgttttgctgacacacgtcgatgccccactaggccttatatcgactgtcaaggcaaagacctcgctccctattatggtatggatcagatcgagttgaatgatgctttgaaggctgcacaaacgctaagaacctcttgaccgttttctaggtcatgatccgcccaaggtagaaggcaaacaaagaaaagttatccttgctcaagatctaaatgtctgttactgaaagtacgctcctccctacatgcctcctctttggacaaacctgcagaggtggcgatttctgttatgatgagaatgaatttgaggcaatgatgctggatatacaggtaagaatgtgggtggcgaggcgggttagtgagagctgccttcagattttctatgcgctcacttgtcatgactgaagactctcaacaatggtagatgtgccacaatctcaaagtcgatggcgttgtctttggggtgctcttgcctgacggctcagtcgacaaggtccgtacaagtcgtctggtcgaagcagcgaagcccatgcaagtgacgtttcatagagcgtttgatatggtaaaggagcccttccaggctctcgaggacattgttgcgatcggtggcatccagcgaatcttgaccagtggctgtgagcgctcggcttatgaggggctcgacactcttgtggagctatcaaagcgtgcagaaggcaggattatcattttgcccggcgcaggtaagatatggatgttcttggcctgggcagcaaccccatgggaaggcgccttgaagtttattcttaaccgtccgtggctcactgcatagggataacggagcgcaacgtggacaagatcgtatcggcaatgaatgcgtctgaggtgcatgtgggagcgggaggctcgaaagaatcccaaatggagtaccgcaacccatactgctcgatgggctacgctgtctccgcgcccgagtacgcgctcaagatcacaagtgcggccaaactgggaggcatgctccaaaagttctagtcgtcctagaataataaatgcgactgtgtgaacggcaccgtcagctgcgatcttgctgccgtacaagtgccagaaacgaagacgaggagggtgcatggatgcctgcgcgcagcaggaggagtccaggagacagagcgcgagcgaccacaggaagcggctctgtcggcacgcggcgctcaagaaacgatcaccagccaatgccgtgcaggcgtggatcgagagtgcgcccgtcaacggcctgcctccgctggtggtgcgacagacctcttctccgcaagcccacacacagacatccgaccatggctgctgctgctgctgctgctgccgatcctcgccacaaccgcatcgtcacccactgggccaggtcagcaccagaggaagggatccagctacacctccgctgcgcagatatccagcgcaccggcagcagacaaaccctgtcagtggagcatcactctcagccccgtccacaaagtagcggcagtgcctcgtgacctcttgctcttctcctgcccgcagaccaacagctctgagccagactagtccagtggaagcggagaagccacgctcaagatcccaacccgagtctgatccaacagctccaatattatcatcatccccatcatcatcatcatcatcatcatcatcatcatcatcatcatcatccacgctcctgctcttgactcttgaacgcatggtttctcaaggcgcggagatggggatcggccagtcagtcgagagctccacgtctcctggtcgggtccgctgcgaatcctatcggacactgtacatctacagccccaaactgaagcgcgatatctgtgtacattcaatcaagaagcagccctggccacagaacggtaatcgtcgcagcaatgcaaaaggaatgaaaggaatagcaaagcaaagaggccatagactgacgatctatacattatcgactcttcactttggccttaagtggtgtttgatggcatggatgtaagcgagaacggcggcaaggagtatcattttcagatttggctatcagggccgaacccacgacaggaggatacgaggacagccgccagattcaatcatatgcaacagctgttgcgggcgatgcgcaaagacagtgctactgcgaatgtcgagattattatcaagaacagaaactcgcaggatcgaggacaattggggttgccagaggcattcgaggacagacgcaagactgagaccataaaaggaagcaaaggaaaggattcgacgcattatgtctgcaatgcaggagtcggtgttggggctcaggacgagactcgatggcgtcacgacaatcaccaccctagatcaaggcccacaaatgtgtcctggaggggatcccgttcttctcgcgcatgcccaacggcgggtttcgagagggacttgcgagcccgaggggaatgcacaggatcgagctgtcggacgacatgtttgatgcaagtatcatggaccatctgctggactatctttacactcacgaactagccgtggaagacagcgcaagccttcacgagaacactcgttctcgggatcaaagtctcaggtgtggcactgcggagcctgcgccatcggcctatgttcatcatatcattagcgccaatgttggcctcaatctccaaaccgtcatcagtgaaacgcggctcgcaagtcctgggaactatggccattctgctcaggagtggcaaccaacgcaagcaaacgcggagacaccgagcttgaccctgaagcaatggggcgctttgtacagggcaggtgtgcatctagaggacaagttactgcaggccgtgagcatggaaaaaatcaagggccgcttagatccagacacgacttttggatcaagtcctgagctggggccatcagcatgaggagatcaaaaatatgatggtgcaatatttggtcaagaaacgaagacatgtgtttggagaagagcataccaacaagctgaggccatatctatgggcttgagtacgaggaccaagtggagacgcttgtcgagatcacgagtctgatggcaagacagccagagtgacccattctggatagaatcacaggaatgcacatatgagaagagacgactatgacgttgcggcggcgcgcttttacttctacctggagagaatcgaaatgatggatggatatgttcttcacagtcggaacttgatggttaccatgccagccatgctaagctcgtaaaataagacagaagttagaggcactaagctgcttccactcactcacttcataaaatcagcaaggcaacttacgcggcatactgcaatgaatgcgaggatgtggccataatgtcgtctaacccgtcgttgttcagatccgcgaccaaaagctgagaaccgaaccgaccgcgaaagtcagacccgataaagcactgtaaaatctgctcttgcctctcgtcgccgtctccaccgtcatcgtcgccatcaccatcaccctctctgtctcgtcgtcgacctttaccgtcgatgattcttttcgccctccggttcgacgtgctccttccagtgctcttcggcctgaaacggctccgacgcccgcggtagtcgctctcatcctctctcgaatgagtcggctcccactccacgatgcggccagcttctgatttcgcataaggctcagccagccaaagactcttgccgccggttgagacgctcattgcagccgatagatgagccattgattgagatcctcgcaaggaatcgcggacgacgctaggatcaaggtcaagttctgaaatcataacctccgctccctcctggagttgtgtaacatcaagaatacgcaccttccccgcttgccagtggcgacccaggcgtggaaggcgattcgaaaagccctctgactgcgagtcaaccaccagaaggtcgcgtcttctggaagctggggtatgttgatggccgtgggatccggctggtgactcccagacaacgtggttagatgcgagacgcgacccgagctgctgaaatttggtgtcgctgtaagcaatttttaggcaaaggctccggagcagagtttgatctgtgtctgagtgaggccgagaacgtccccttgatggggattagatacccctgaatcttgccgcgcatcgcatcgtcttctctgaggccgaaagtgggcgaccctactaccaaaattctacgccgttcgtcgttgcgcatcaagtacttgcctcgtatgccatggcaaggtaaaaaggagagcagccaagataaaacacgttacagctgactggactttggcgacgcttgtccagttgccaacatacattagacggattaactacattatccacgctcaaactatgtgctaacagggaagaatcttaaaaaggatgtgattcgcgatcccttgagcaagtatggactgtcggttgcaggcttacgaccagacgcgatcaaaaaattgcacgctgtgagaaatgcgggtgggtcacttgcgcaggatattctgacagcatgtcagagtatcgttttggccgctggcagcagtgcgtttttgctataaaaaaaaaaaaaaaaaagagatcgaaggcaaaaatcttcccagtccggggatcgaacccgggccttgtcggtgagagcgacaaatcctgaccactggaccaactaggaatcgaagagctttgattggctgtctttccagatgacatgttgcgagttccagccttcctagttcccattggccggacgcgcagcccatacgagcgccaccattcccacattcgccccgcaccttttttgtttattttcccccccctttttacacgaatttcttcttcattccccaccgacacgacctaccctatgtcgccgcaggacgcagaccacccgagacgacctcagcactaccaccaccacgaccatgcttggaccagcgagcgaccatggcagacaacatgaacacgacgcctaggaaactaggatgcaggatgcacgtacctcgtcaggtgcaaggccagcccatccccgatgaccaagcatctaaacaaacggccgctccagcaatcacaccttggcacctcccccccacgaccttagcatagaggtcgacgaaacgagtcgcctcaggacgagttcggacctcctcccctgttgacaaacaccgacgatcgacgactatcaatcacgatcggacgcgcgtcaaggtctggaccatgagagacaggccaaggaggatgaggacggaagagtggtgatagataggaactggaaggtataaaagaaggacagcccccgtagaaaagatcctcagcaataaacacgcctccaaaagcaacacatacgctcacacaatccaaagaacccctgtagaagcctacaaaagtccctgaccaacaagaacgagacccaaccgccagaactcagctgccctctaagaacaagaacactctgtcccaacgccccatctctccgtgcaagaacacccctcgacaaaagcccttcctccgatcaccaagattggattgcggtgttattttttgattttgttatttctttgcagttctctctatccccttcctttaccctccctatctccaacgagtgcccagacctctcagtccgacgtttgtgcattccttacctctgtagctgacgatcgcaccttccctaccgatctttcacgcgacaggaacatgtttcatgtttagtgtagtgtacccgtgaacagaccaacttggaacctttcatgcactatctgtggtcccccccggcttttttcccccaaaaaactggttttctttcatgagcgacgtggatgcgcgctttgatgaagagatagtagctggtgcatccagattcagcagtgagcgaagcagcggcttttttacagaatggaaatttcaagttcagctcttcaatgcaattagtttgacacgacaggaaaggcgctgccaggttgcggaatatacaacccaccaagtcagttaagtccactggctggcgagagagcgagagagaacttttacttggtcttcgtgagattctactcatcaatggcagcaatgaattccagctttttttcttgtataataatttttattttggcgggcgaacgctcggacctcaatctacaatcggttgacaccctagaccttttttttttttttttttttttttgaaaagttctgcacgaaaaacatgcgtcgaagtcggactcctccatctgatgttgaaattgtttgtaagaaagaaaatggactaggatgtgaatgtgccgccgccttgtttgtagggctcggcatcaccaagacagcttgcgatgggtgccatggtcaagggcttcttggcataggctaagggcagaatgccagtgatggcgacatccacctcttcggggaaaactaatagccatgacaaaaaaaacaacaaaaaagcaagagaggttagaggacgtaagaagaaaaaaaaatatagaaagatcgccatttttctttgtttgtttgttatctgcgttgcattacgatcgtgctcaagagctatgaagccagtcttcatagacggaatcttgaccagccatgccttgaaggtgtcaatgactgactgaggcgtggccaaccctgctgggatcttccactgagaacaagcgcaggaacaacaagataaaaaagaataaaaaaagagccaacgaaagaaagaagtttggtatgagtgatcagtgtcgccaggaaatacaactaaagtctcggtcgtcaagcatcccctgaacattgctacatcgttcgtgtcaaagccttgagtccagatcgttgttttgtagcctagctgtgtggcaatgctgcgaacgcgtgcatccacatcacctgcaaaaaaaaaaaaaaaggtcagacttctttatgagttcttccatcgaaagcattggtaagcgtaagatattttaccgtagggaggacgctagtacagaggagtgaccccaatggcactgaaaatcgccttctcggtccacttgaattcagcaacaatttgctcgttcgtcaagctggtcatagcggtatgtgaccaggtgtaggcagcgatttgatgaccctccgtgtagtcacgcctcatggcagccatcattaggccatttcttaaacgacgggggcaagcagttatgactaggcatgcagtaaacaaaaaaaaaaaaaaaaaaagggactcggtcgccaattgcgcgttggtcccaggaccggtccacgtcccggctattattaaatgacccaaggcttatccactcgtcaactcgccgcaaagggcactgcccacatccctcccccctccccccctccccccctacacacacttctttttactacagccattcattccggcaccagttgggtgcccccgtcgcatttgatccgtcgaaaagagtggtataccaaaatttcaatttcactaaaaaagatatatatcctagatacttgcaagtctatgggtaaaaaaaatcgtattcgtgcttttttttttttgcttttgcatctaccactctgctctagaagatggcagcgaacacagccaccaggaaggagctgccagccatcaatgcagtctgggttcctgcaacagcaagcgtctttcctgcaccgttggatccactgccgctggtgccgttcgacaccagcttgaatgtgcccgcaccttctttgtaaggcttcgcatccttcaggcactggggaatgggctgcatggacagacccttggacgagtacgcaacgggcaagataccgttcagagcaacatccacctcctcagggaatactaacgagatcggtggggtaaggtattaggcaattgctaacgttagtccagcccggttcccatcggtcatcattcttttttttcatttttttttgaggcggatgaagaacagaaaatcttactgtcgtgttgaagcacgataaatccagtctgcacggtggggatctttgtcaaccagcccttgaaggtatctacgaccgattggggagttgcagtcttggctgggatgttccactaaaccggttgtagacagatagaacgatcggccgttagtgacgcacttcatcgacattttttgcttcgaaaaagcaggcactgcaagagaacacatacatcattggtgtcgaatccctgcgtccacattgaagttttgtagccaagctgtgtggcaatgtagcgcacacgagcatccacatcccctaaacacacacagcaaaaaaaaaaaaaaaaaaaaaatgcacggacgatgcgttaggaaataattgcgcacagacatagatcataaaaaaacactcggagggtgttggtctgaatctcaccgaagggagggcgccagtagatgggtgtgacaccaatgacgtcgaaaatggccttctcagtccacttgagctctgcaacaatctgctcgttcgtcaagctggtcatggagtggtgagagtaggtgtggatggcgatatgatggccttcattgtacgcttgcttcagagtgttgggatagctcacggcacgagaaccgacaatgaagagagtcgccttctggttgtgctccttgaggttcgcgtagaggcgaggcgaatcgggagagggtccatctatttacatgcaaacgagaaccgggtacgagacaagaccgagagcattgttagtttcaggcgataaatgaaaagtggaacgggtctgtgatgggttcggagtatggagagaaagggacagcgcaaaaaattgctatccttattgttttttagcgctaaaagtgtgcctcttttggcggtcatttcatgggtccttaaagcctactccttatcaccaactatgtctcggagagggaggggcgagagccaagagcagaggtgttgaaagtcggtgaaagggataggaggacggcactggagcattgttacgtcttgggtgtatttgtggtggggggcggatttgccatggtgtctttttcacgtcaaagatttgtagccctattgtttcgttccagggcatacacatccctcggacggcttgtgtcactttaccatcgtaagtcaatccccaggtgccgggggttgggcatgatgtgatgtcgtcaggcgcctcacacttctggcatgtccaccagcactgctctttgggaagagtggaaggatctggaggacagaccccgtcggccgattgaggaaagactggggcctttgtgagatccaccagtttcagccaggcttgcacctgggggtcttgcgtgaatggaacgcagtcgatggctgggtatgatccagcagcgatgggggcgtaggttgtattgcaggttgcagctgcgcgcttctccagcgcgtgtgagtgagcggagacgagggtcaacgagacggagagagagagggcagcaaaggctgtgaatgtggagctgatgtggaccatgactgggaaggattatgcgataacaaagggctgttgtttaggtgaagtagagggaagatgaagaaagaaggatttggagaagcagacgaaacatatatacccgctcgaaagctgcgacgaaagagggacccgatcaagcaatgggcagtcatcggctaccgagaacctacgctgtgcgtgcccggacacacgcccctgaccactatttttaagaatacacaaaattagtcgtgcacaagcctggcatacgaccgccaaagccctgatcgtctatccaacccacgctcaccctggcgcgcttccattctgagctgccacgctcaaagagatacccactggattaccctcgcctttgctacccaagaaaacactcgagaccaagtagacctggtaaatgttaaaactgcttcctttcgtttatatgattgccgcaaaaaatgcataccgccttgaccctatggtgccagtctcgacaccattagccagcaagtgcaatctggcggaggcatttgtagatagctcttcatagaaaatagatgcacaatggtgaaggaaaggtcgttttttgcttctataattcatgatagaatcatcgtcaacagaaaaattcaatgacgcttggcccattgtcagagcaaatatatctcatggactaaaaagcgagctgatcattcagggacgcactagccttgcgtggttcttgctctatttataaatctctttccctggtacataagataatcaaacgcggacctttccctcctaccgtattcacgtacggtacacacagctgactagagtaacaaggacacacacatcgcatctgtctagcgtcaaaatgcccaaggcatgactttttgctttaataagaagtgtttttgtagacagatatgaatttctcgaaaacgtcagcgaaaggttctcgtggcttctacagagcggccaaaacagcggccatcagtccagcagcggcggcgacagagctagcggccaatgtgttcccggcgttgggacgcttgccagtgggagaaggctggggcaccgcgctctgcgtaggcgcgcgcgaggcaatagatgtggattcggctgccctagtcgtcgaggcggacagagcgagggtcaaggcaaggatggcagcaatgtataaagtgaccttcatggtggctagtgtggttgcgcagggaggggggaaggggaagacagaatgtggatggggtagagaaatcaggaaaaggccctgggttcaagaatggtgctcttttatagtggcgagagtgctgactatcaaatgccggcatgggttgacgccagggcgaatcgaaggatttgaggaaacgaggctgcgtctggtttgaggcagcaacaaccctttgaaaagcccaaatgttttttgctgacatggacatcgatcggacatagaacaatcttcctttctggtcgatgttcaagagtttttagacatcgttattgtatctcacccacgccatcttcctgtctaggcctggacgccaaacgcgatcagagattatgatctatggcaactccaggtatttcaattcagtactgatttgaaatgggctgtggcctcaggaatgaggaacgccttggagcacccaggggttcggcgtccaggacagtaatgagccaagattcgtctctgtctttgttaaattggcgcccagagggtctggggcgggcggcaagtgctaatgaaaaaaaaagatgaatggcgtgaagggtaacaagagaaatccttgcgccgagagatccaaagagactgtgccaaaagtacggctgttgggggtcgacctctcgtttctacgagaaaccattaaggtttcaagcgcagtctcaacccatactaaaaaagaaactactgtccatgcgccagtgtatggaacaggaaaagaacgggagcaaagaatatttattcaacttgtcatttccttttcatggcctctcatcttgcatagtctatgaatcagctatgagtagaacaagaacgttgtaatcgacagcaagggggtgcaaagatggaggtccagaggtggcgtgggtcgagaatgtggggcataagagttgaaagtgtgtactgtacaggatgtataggatgaggcagagaagggagggatggggggggggggggagcatttggatgtaatggcagtcatgtcggttgactgaagagtggttgatggaggataagggccgggacggtcgattaagaaggagtggggcgtcttgacccagtgggtcatgacttctgcattccgttcagagtcaagtccgtggcgtccgtgcgaatctcgtccacaaagctccagtcctcgttgtccaagaaatcgagttgcagctggctcaggctgggcatggattgttgcagctgttgcagctgcatccgctcttgctccatcaactgcaactgcagcttctgctcctcttccatgccttcccggaagcggcgtctcaagctcagtcgctgctgcatctgctgcgctagctgctgctgctgctgttgcagtttcatcaaggcatcctggccctgggtctcctggcccagttgcgcgaatgactgctgctgctgttgctgttgctgttgctgctgctggtcataagagggcgacattgcagagctgacatccgatcgctgattttgcatggacatcaggctcatggtctgaggcatggtctgaacagtgggctgagtctgaccgaatcctggagtgccaaggttggtcatagccatgttcatgtccatgctcatatccatgctcattcccatggacatggcaagattcatattggacccaagatccgctccattccgtccagcggtcccattgagggcgctctcgaaatccagatcgtccttcatcatccttgcctgggattcgcccacaaactggcacatgtcgcgataacactcggcacaatccacggtcggacgaccgcaaccacaaccacagatcaacactccattgttgccaaggagggtagggtgctgcatcttggccgagtccaaagccgaaagtcccattcctttgaactcttgcttcagagcttgacgagtgttaaagtccatggaactggggtccgcctggacaaggctcaaggcagtgctgagattgagagtctgcgccgttccgacgttggtgcagctgttgttcaacaaggaagtatcgttcacaagggccacgttggtcttattggatccacagcaggaagccgcttgcgctgaggcgccgctgttcgattgaaggtccatctccaaagagccgttcaagagattttggttgttgggataagccaggcagccagggcaggcacagcgttcaccgcagcagcacatgttgggcgagattgcacagccacagccgtccatcttcactggcaggtcgtcttcgccaatctcgctcctgccggcaggaggggaatgagacgggatcgacgacgctggcgaggaagcagtgccgcgactctttccagatccacaacacccaatgttggcagacgaggccgaagaaacactgggattcgaagacaggccaggcgaggaatacgatcgacagggaggagtggggaccaaagggggcgaagttgtcgagaagcttgacagggcagagtacagcatacgaatctcgtcagcagaggcgctctccattgggttcaaggtcgtcgtgccattcatgattccgtccatgatctttttggaatcaacggcattcatcatgtccagatcctccatgtcatccgaagcattgctcacgggatagctggtcagcgcttccggaaagtacgagtacgaggtcgtgggattgtagtgatcactgtcgtagtcggacgagctcgcgtagtcgaaacacaggttggactgcatctgactttggtggctacccatcgacgacgacgagggcgagtgatcgcaagcggagcttccggagggcgagagggtctggacaagcagaggagaggcgatgcccgtgtgcataccggcgctattaagtccatgagccaactgaccatcggcgctagggagagtttgaccgccattcgtatgcgggacaaacggcagaggcgagccggactctcgaggaaagtggagaatgcccgacttgccgaggtctagggaggcaccgctacgcggacggttggcctggtagctcttgaagacattgctaccggcatgggccgatcccttgccaggcttgacgacaacgtggcctgctcgatcacgacagcacgagcagaccatgccatcgagacagccgcagttggcaacacctgaaaataaaacggccgggttaagtatgagagagtaacaggcagggagtacagagatacattgagtaatctccatagctcactttccgccgcgctcatcaacctgtagcaccccttagaagaggagcggcagagcgtgagagcgggggaaagtgagcacaggattgattgtctacctccagtggacgagcgggcgtccagcgagtcctggggactctgaccttgcgacgagagcgagcggagaaggtcctcgccgccgttcgggttcgagacggggaggcggccgtcgtggctaagggactttgcacgcttcagaccatttacaacggctgcggatcctagcaggcgtgaaagcagaagtgcgaagagtgttaaatatggacatgtgggtggagtgggaagcgaataatcagatacagcgtgctggaagggatcgccgctgcttaccttcttcgcggccacagatgcagcggacgtgcacctgcttggccttgcgcaattccttgcagtggggacactgggtcgaggggcgacctttcttcttgatttcatgcaagggtcgctcactgacgattccgatataaaaagaaggctgtggatgtgagcgaggggacaaggggtgcaaggagagagggtcaaaggcattaagaggaggcctgcagtcgtttacgtacccatggttgcaggtggtcgagcggtggcccttgatacaggtggcactagcgacaggcaatcagagaggtcagtcaagccagccaggtcagccaaattcaagcggagttgaggctgctgggtgtgcgttgcaatcttggcaatctcgctcggtccctctctacggacgatcctcgattgagccgaggggcagcaagggcttaccacgcaaacttttggccgttgagaaagaccatgacgagggacggggggatggacaggcactgtaggagtagcaagcgagggtcaacgggcagctgctggtgatgcgttggcgtttttttttgtgttgtgttttgttgtgttggactggaacttcggaaatagtttttgcgggtcggcgggctgagctaagtcctgggaacaggggggtggaactggcgttgaaggtctgctcctcggggacgatggtgtggagtcggctccgtgtgctttcagtcggctcgattcagggacattcaatcagtgctggccgagggagaggaggatgcggcgagagaagaggcgagagatgacgggacgacaggacaacagaaggacgaggatttttttttttggttctctttttcgatttcttgacagaagaacgagagcgaggaggcgtggggtggggggggcaaagggctatagggtaaacagaagcatatgtaaaagaaggaaaaggctgggtgctagggggatatgagggtgagtttgatcaggaggaggggtccagtgcagattggcagggttgaatgggacgagtggaggtgttgccaagcgatgacagagagtgagagagagcagagagagcagagaaagacgagagagacgagagagctgaggcggtggaggacagtgccgagaagaccagagcagaaggctcgagtggcaatagctgtcagaggagatacaaaaacccgagatgcaagcaaacggggggttggccctggaacaggcaccaacgaagcgaggacgggacgagggaatgcggatgagagtgtcggattcctgggaggtggaaaaggacagacggatggagaaggactcggccttggagcagctgctggatgagaacagaaagacaaggaaaagagggttggagagagagagagagaggagcagaagagaggaaaggagaaggagaagaagaagaggaagagtcaagacaacgagagagacgaggaagaagaagagtgggcaataaagaaaaataggacaacgcaacacaaaaaataaaaaaggacgggagttgtttgcgactcaatcaatcaatcatcgtcgaatgatagtcaataataacacaggtggacagacagacagccctgttcaaatcagcaccggcgcacttcagcacctcatccacatatctcccttggctagactatcatcatcgtcgtcgtcgtcgtcctcataaaatagagacgagcaggcgaatagggtcatgagtaaacaaggtgccacactcgctgttctgacaccttccccgccactcatcgtcgccggctcaggtcaggtccgcgcaggtgtagacgagctaccgtacagcccttgacggaaaccaactccctcgtctcaatcacactcaacacacaatataaaaaaaaggtgtcaaatggcaaggcatcgcaaagaacataaaaaaaataataatcctgcaacactttactgctgcacccacagcatcatcgtccctcctatctggcaaaagatatgtgtctggaaacaagggttcacggcagatgtccctccactcttgcccatgtgcgcgagagtttgcaagtgtgcaaagaaatcctgttgctcgacagattaccgtgctgatcggatgcaaaaactgcagtgccctcttggctatcctggctggtgaacggcttctctaggttcaaagatgcatctttccgcccgtcccacgctgcactccagtccaagcttggcgcacacgattgttggtaccacgctgtgaggcacgacacgttactattcctgccagcttctcttgcttctatggcagataccgtttttttttttgctcacgcctcccatttgtcccattgtttggcagacgcacgcacggcaacagtaggctgaactgattatgctccaggtacatgcattatgctaccaacttgtaacctgcaaatgagagagctctgcgatcaattgcaccgagctgaactccattttctgagccaggtcgggactaagctgagatataacaacaacttcatcatcgcacctgaaaaatggaatgggacacggccagcgtttgagggcgtttggatagggttgcgcggagtgaaactcaaatcagggccacaaaagaaaaaaagagagaaacgttctcagcagcacctgccatagagaaaaaaagaaaaaaaacgttcgcagaagaaaaagaagggctactggaacattgcggcgtgttgcatggccgcgtgaactgaagggtaccttagcccgcgcgatctacctggtgtttgtgcccaatatatgctgatcgacgctgagcatgagtatacaacttcacagacaggccattgccccatagtgcgacctcaggggcagaccccgaatcgacgttgtatttatatcgacacatcccaaattcactcatatttttggacagctgctggggacacagttgcaggcaaaggccaagcaggacccctctcgctcagccaagcaagatgctctggagaggggcgcaccttccatccatcggcgcctaatgcaacggagcaggcgctaatggtggtgcaacaaagaaagaaaaaaaaatcatgttcaccccgccagccagtagaaaaaatcgcgcctcccaggaaaattttgcaagtgaacgcaaagctccgagtcagccgcaaaccgagagcagcagatgcggtgaagcaagcatcgtgtgcgtttttgtagcctcgtttttttttaatgctcctttttttcagcctttgccttttgggtgtcgtctaaagaaaatgcctcatttttatgttgtcttccttagaacgtttccttgccttgaagtcgatgatgcgggtggcatgtgttgctgccaatctccctcttctccttttggctcctggcactttatccctgtttgtgtttgtgttgtttgtgtttttcgtaccaaagaatgccatgcgtcccgcacgcacgcacaagtgcgtcatggcacgtgttgggactgcgttgctgatcgaggaccaaaaaaaaaaaacgccaccaccgcagccaaaactacaagccacatctcctccagtcctgaccttttttttttgaagtgcagacttgagcattgaccaattgatctctcacctccgtactcttcttttctctccctatccacactccacacatacacattcgcgatggcagaagtacccactttcaagctcgttctcggtaaaaactctttcctcagcagattagcagcgagccgcacaaccggctagatccatagcgatttgaaatgaacaaaagaacgcgcaaataagcctatcgtactcaccgtgttttctctccttctcactctgtttgttgcccttctgtatcctaccctctctcatagtcggagatggaggcacgggaaagaccacctttgtcaagcgtcatttgaccggtgaattcgagaagaagtacatcggtaatgggacaaccagcacattttccgtattcaggctcttcccctccccctggattaacgattttcaggaacattcggaggaagttggtggtcttcataagcaagccttgttgaagtgctttggcagtgtcggttgcgcaggcgaagcatactgtatcatggaggcaggcgtcggcttttttttttttttttaccagctcagcggataacgcctgcgcctcttgagccttgccacacgcgtcctctgcttaacagcagcgcctcccccgcagctcttctcgcccaagtgcagcgccaccttcccctatcccacctggcattgtttgtttacattttttttatatatttcaggaggaatcagaattcgatcgccagtagctcagtgggatgctgaactgatagagagcagttctcatttttggcccttttcctatcttgggagcaacacgcaaccgtcttgtccgccaaaatagcgacagtggatccacggctaactcacttgacgcttttgctttattggaatttctatagccaccttgggtgttgaggtccaccccttgagcttcaccaccaactttggccagatcgtcttcaacacctgggacacaggcaagttcaccatcttgaaacaacaaaaatacataatgaggaggttttattttacagtcatgagcaacactgaggcttacaatgtcttttggaatttcgttgacaatagccggccaagagaagtttggcggtcttcgtgacggatactagtaagtgcccactccttcagcctcactgctcgccgatgaacataccatatgcagagttaatactaaccatacaactacaccgccttgcttgcgcgcctacctctcaccatctagcatcaacggacagtgcggaatcatcatgttcgatctcacctccagaatcacctacaagaacgtgcccaactggcaccgtgatctcgttcgtgtctgcgagaacatccccattgtcctctgcggcaacaaggtcgacatcaaggagcgcaaggtcaagcccaaagccattgactttcaccgcaaaaagtctcttcagtactacgacatctcggccaaatccaactacaactttgagaagcccttcctctggttggcccgcaagttgtctgcacaccaagacttggagtttgttgcttcgcccgccttggcccctgctgaggtccaggtcgatgagaccttgatgaaggagtaccgcgccgagttggccagcgctgctcagatgcctcttcccgaggaggacgatgatctgtaaaggatgctctcttttttcactttctcttcgtttctccctcttttttctttttcatttttctttcacctttctttctttcttttttgttttggcatatcgctctagtttaccctccccctcccaccacacactccttcatttttctccctttctctgtttacccatagtctatagtctttccctcccactctttctgtctcaaacaccttttttttctttcttcctctcctcaagaaccaagcaaagcaatttgaagcacaaaccaaataaagattcccagcagaaaaattgctgcacacccattcacacacacaccaacacaccaacacactaacattctcatttcaagaaaggatggggtataaagctataaacactgtatttttttctttctcgagtcttttttgttgttttcctttttttttttttttttcacaacgatgttgcgaggatatcgaccactggcgagggggactccaatccacgtcctgttgcagtcgcgttcttctcctggtccacctccttcttgtcctgttccttcttgtccttgtccagctcgttcacaagcgccatcagcgccgcatggttcacaggatgggacgacctcagtgaccgtttcctcgtgctatgggtgctcccactgctgctggctcgtccgtgtccgctcgtcgagccattctttcgacgcgtcgatcgatggcccccagtctcgggtaagggcgtctccacaaccgtcaccactggacttcgcttcgtcacccctatgggcgctgtcgtggctgctgtcgtggtcgtcttagtcagcgagggtatagaggcagcagcagcggcagcggaggcgacggtggcagtggcggtagcagtggcagtggcattggcaacgacggatggagctgtataggtttggtcgagttcaatcgccactccagaatgacggtactcccgactcctctgactgcgcggcttccgcgcactgctgctactgctccttcggagcaggccaggcgggtcaaaatctgtatcctttcctccactgctccctccaccaagcactgtaccgaatccatgcgtcgtaaagttatacacccgtcgtgcaatctgcaacggtcctcgcacggctcccaaaagctcgtccaccagcgactcgcccatgagggaccatcgctgggctccataatagggctggtgcacccgcaccgacttggagtgagccgctgccttcatgcccgaatccgttcctgcggctgcggccgcagctgcggtggagcgcacgcccgacgatgagacagtgcggcgatcatgcgacgactttggtggataggacgaggaccctggcacccttgaatcggaggctgttggcggttgaaatgtttgctcgcccagcgcagccctccgattgccccttgtcctcggcgtaccattctgactcctctgcaaactgcgaaagctcccagaggaggtcgaagaggacgaccacgacgatgaatggtagctatccgtccggtccggaagtcgtgcgatagactgaggggtctccagttttttggaatgctctggtgagggaaagaaggacagcatgccggacggcactgtgacgagctcctgccgccgaagcagagtcgttctgttctcaccagcgctttgggattccacaccttcacgtccgccaatcgtcctgccggtgtcgagtgcgtcctccgtctcataaaagtgctgatggtgaccataggtcacaaacgtgctctcgtcttgatgctgtggctgatcctgatcaacgtcgtcctcttcctcaatgacatgatagtttcctttgcctccatgacgtccatccacctgtgccgatcccagagcgttcacgccgctcgccatgttctcatgtgcactcacatcagacgatgctcgtcgagatccagcattcgatgaactgcgcgaagttcttgccgaatccgcctgtttcaggggttgcttctgcagatgcgcatattgccgaaggtctgtcgtccgatgccgatgatgggtaggattgatccggagttcctgtcccaacgccatcgacttcctgttttgctgctcagtcgacaccagatccatttccttgaaacgtgcagccaaggcttcgtgagtcatagatggcgacacaaccattgtgtccgggagggtttcggacaagggggccgctgtggaggctggtcgagcacccgaagtgaaggtgtttgcccgtcgaggtgtcagcgcggacgaccccatcctgctgtctgccttgtgtgtcgtcgtcgtcacggcgtgcgaagacagtggaggtgccaccatagactttgggtcattccaggtgccgaggcgcggtgaaggggtggtcgtggatgatgaagatgagggtagcatgccagctgcgactgcagagatgggtggaggtgataaggggtcctccaagccagctggactagccgcaatatgaccgccaccttgggcctgctgcgcgtcaggttgatcgccgccggccgtgcctgggttgccattcgcttctgtggctgatcctacagacagggagccatgttcgtcttgagtcaaagactggggaaccagtgaaccggtccgggtattgtagctctgctgcgctctctgaggcaggatgacggtatggttgctttcatcaatcgtcactcctgcttgccgggctacagtgcactcttcaaatggaatataaagatacttgcgcgtatggatcgagtcatttgtccacagtttgttgcactttttcaaaacagtgatctagtacaagaggtgacgcattttagtaagtagagtggtggcgccccgaaaacaagcttttcttgcctcgcgtctgcttgatcctcacctggatcccatagtaaagcgcaatgccagccaaagtgtcagtgatgcagacttgatgaatgatgacccgcttccccgctgcctctgtcgctgctctagagtggacttgattcttgcctctgtgcgacacgatgtctttgtcctcagcctccttggaaatgttgcgcctccgcctcgcacctggtccttgtgctgggaacgccatctcttgtggctgacgggaagtggatccctgatggttatccacgctcatgctgtggcccttgtggcgtaggctggtgggccgattccgcaggcgaggctccaaatcacaaccccgagatgctgtgcctgtggatgcgtcatcctcgtgcatagcatcgggttccgctgtgtagccgagcagcaaggggtgatccccacgccaagtcaagctcccagcttcagagacttggtccgaagtatcagtggtggacagcgggtcgactttagtcgatgacgaacgtgagctgcctgagagcatagtcgatgacgatgtcgatggacggtgcaggagatgtctcgggaaccctgaaagctctgctgacggctctgctgataagagtagctctggagctgttgaggagccacccagctcccaatgaactcctgagtcgatcgcgcgctccatctccagcggtcccatgtctgtcaaatgctccaggggctgctgtcttgactgcgacgacggcggtgggccagctgaggtgtgccttgcagttggcctctgacgcactgacttgtccaagggcgttgcctccactgcgggctccagcagcgaagtcgccagggtgctgactgctcttggtgtcgtgactggtgtccattgcaggtccgctgtctttgcctgggtgaggctgggcgtcgctgagggctctgattgcagatgtgcaagggggccagtagagttcgcttcgctgttcctgactgcgggaggagcgctgctgtccgtgagtccagcgcggtcgctgccatgtgtccgtatcccgagccgcgcgttctttgtccctttgacatcatcgggggcagcgtggtggtcgggtgcgtggccctggtcagctgcaaaacttaggggatggtgcatatcgtgtcgcacagttggatcggcgatggaaagtgggtgatcgctgctctgactgtcctcagagccctccgggcggctgccgtccttggtgctgctgttgctgctggtgctgctgcccgtcagggtgcgttcttggagcatggactcgctgcgcccgtgggatcgtgcggtctccttggatgaggcacaggctgcgtggagggggtcctgtaaatggacggaatgcgccttgtcccccgacatgtatggtggcggtgttgctgccgtgccgtgcaaaggaggtggaggggatggtgtgctcatgtgcagtccgagtgcaggcccagtcggcagcgcaatgcggctctgttttggtctggtgcagactgagaccccttcgaggtgggatgggtcgaatggagcgcagggagggggggggcaggagtagcttgttggcacttagcacggcatgcacgggcggaaggagtcgacgaagggcgggagtgcgcgagtgggcgagcgagagcggcacagaggagagcggggagtgaaggaagcagtggcagtggggggagtgggggagtgagtgagtgagagtgagagagagagagtgaaaatgcagccaaagcgtggacgggtgattgggtgcggtgtcgcattcatatggacatcacaaaaaaaaaagtggtcagagtgtcgtgctgtagtacacagttgcagcacgcgcgctcttggctctgtttggcaccttcgcacttcggcctcctattatgcattgtcacagggccactcccatctctcatcaccgacattggcctttcgctcgctcgctcactctctgagcgcagcattgagatcacgcatcccttcctggccatcatccgcactggtgtgtgagtgcgcgagtgtgtgagtgtgtgtgtgcgtgcataaccgatatatattacaagggcactcggaagctgcaactctgaaagggtattcgttcttccaaccatcctcacagcttggctgcaggaaccgcgcttccacccgtgacaaactcaacacccttcacaatgttccccttgagctcgccaatcgcgatccctacgaggcgctgctcctccgccgacagatcaggcagcgccagcacattggccactccctcgggcccaagctctacatcctgtgcaaagtagtcaagccctgtcaatcccatgttccgctctgcgccagtattgcccctcaaatgcacatacgtcgactcgataaggcccttcttgcccaggacagacgcctccagcaacgcattcgtgaaacgcgcccccgcatatgccattgagagcgtagcggatccagccccgtccttggccttaacaacctcgtctcctccaaactggatgcgatgcgtcagcgtcttgatctcctcggctgtcaacgacacctgcttgatctgcgacaacagtgggacaatggtcgcaccactgtgtcctcccaccaccgtgatcctattggcatgaggctcgaactgaggcttgatctggtggacaaatgtggacgaccgtacgatatctagtgtgctgatgccaaacactctggaaagtgttcatataaagtagaaaagatgaataagagcagtgagtaacctggttgtaaaaagcgctagggctcacaaccgacgcagagtgtccaaaaacaaagataaagggtgcgcatctcgagccccagtgatcaagcgttcaaaacgcgtattttggctttttttttgtgtatgtgttggctgtctccaacacactcgctttgtttttccacacgcacacacgcatttgcaggacgtccttacctccggggatcgaaaatgccggccttcttgaacacctcacacacgatgggaaccgtagagttgacagggttggatatgacgagaatgaaggcctttgggcagtactgtgcacatccctcggcaagctcacgaacaatgccagcattgacctacagagttacaatgaagcaaaggggtgagagtgagcaaggaggacccagagtcggtaaacaaaagcacatttgtcggcgcccattagaatacagaagcccaaggacgatcgaaaaaaaaaatatttaccttgaagaggtcatcgcgggtcatgcctggcttgcgcggcactccagctgggatcaccaccgtatgagcgcctttgagggcctcagccaacgaatccttgccagcgtgtcccgtcactttggagggggtgttaatgtgagagagatctgctgcgacgccagcggcatggacaatatcgtaaagtgccaggtgggtgatgatttcagactgcttcagaagcagcgacaaaggctgaccgatgccgccagcggcaccacaaacgacaactattgcggcaagacagtcaatgcggtattcgtgagtcggtgagcggtgcgagcgagtcaagcgcgtcaacactttcaagacacggcagttgtgcagcaggcaagcttacctttgaccattttctgatatgaagtagagagagaaggagagtaggtggggatgtgtgcttgtgagcaaggagggggttcagaaatgataggatacgggatggctcacgctgagtatggtgtggatggtgtggatggaggagggtggagagggaaacaacaaaggcgagacgagagagagagagaacaaaagcgaggaaacatcgattcgtgaaagagtctgttttttatacctggcctgtcgtatcttgcctgataagagaacaaaattttgccagcccagcgcagaaaacacctcctggacagcacaatgccgtgtcctcgtcggctcctctggacccactttttcgtcgtgtgctcgtgctcctgtgggaccccttccccctgctgcccagccctgacgtactcgatgcaaacgcaaggacagcgggatgcaggcatgcagcagaggcggcccatcgcacaaagtaggatccaccgcgctcttcccccaaccttctactttacagtcgtcgctcggtgcgagggcgtgtcactggccgttgtggagcagggcagcgtgtgttcacttgcgtctgttgatttgctctcgtcgatcgacctcgaatcccacatgaaaatttttttctcgtgccgttctcaggaaccgagtgactgagtgtccgagacgacagacgcgcatcctgaccgcactcatgtgcacatgtgtgcggccccagccagccatctcgtgctgcagcactgtacagggcctcagcttcccagcctcgcccctcccgcttccttatctctcgtccaggactgttcattccaccgccatgctgctgctgccacacaacggcctgcatgagagcctcagcgcaccccgcgccgcattcccaggtactcaggctcccgtctcgctcgcagtgttactggtagaaccaagagcacatgcatgcatagagtttggatcccaccccgacacacacatcatcaactcgcgtggcatccgccctcgtccacctccccctccacaaggcccccctctgctccttcagggctcgacattttgttcataattttcctctcgatcttatccccgacagggccggttgatccattgcccgactccgtagtgcgttgatcacctttaaccttcgcaggactttgtcacatacaatgtcgctgtatatacatggaaatatgctctcggccggacaccatacaaagtctgttcgatcaaaacattcatctccgagcaaaagataaaccaaccccacagatcgacccccaatgaaacgaaacaggccgagtgctcagctccacctccctctctatcgccagccagattttctgggtacgagcccacgatgacagtagttttctcaatatatttcaaagatagtttacagtttacatttcagaaaattgattggtatgcgctgactcgtgtcatgttcatgcatccgcggcagggagtagaaatggtgctgaggtctttttttctctttctttctttctttctttgccgctcatctcatctcgcctctctctctttttttcatcgatcacaaaaagtagtcgggcggtccttctctctgagggttcgtacgggaattcatcgcgttgcgctcagagtctctaaagattgtatagcttttttccagattcgagtcgatctccaagattgccgccacattcccgcacctaccaagttgttacgttgaagaacgagttagactaatttttgaggccagtggatcaacaagcatcggaagatgatctctgcaagataaaaaggggtcttaccggtaacagtagttgggtgctgaccacactgtcaccacagtctcatcaaacattaacttatagccctccataaccaactgatgtgcacgcgcaataagctccaggccgttattgtgcaagaatggtttggccacactctcgccaaacaggaatccagcgccacgaggactcagtccccaacccgtgcacgaatctgggtctggatccgaccagagcaaatcacacatggcgccgttgtgaggaacctcctgcatcctgtcgatcgtccgaatctagagtgaggtattcccaaaaggttttggatatccgtcagcttcagggcgagatacagtcacccgtgaacaagaagcaagtgaagcaagaccatgctattgtcaccctacctggtcgatcgtgttgatggacggtgagagtcctccatggacgcaaaagatgcgatcgtcgatgatggccgacaagctgaggtaatcgaaaatttcacaacagtatctccaaacattggcggatccaaacttttgaaagcactcgtcatagaatccatacaccttggtgatctgtcgtgattcgtggttgcctcgaatgagagtgatccgatccgggtatctgacctaaagtaaaaaacgaggtggtccatgcgaaacatgagatgcttgctccgcacgctaccataagaagcttgttgcaaatgggaatcgttgaaataccttgagagctagcaagagcaggaacgtctctacactgtgatgtcctctgtccacaaagtcgcctgcattacacaaacaagtagaaaaaaaacggtgagcataacgtgtcctacgaacaacggcacgttcgtttatccacagaaatcaacaatccaggaagcttgtaggcaaatcagccttacccatgaacaggtagttggtttttggacactcgccgccgacctcaaacagttttttaagatcgtggaactggccatgaatgtcgccgcagacctgcgcagacacaaagaggcgaaaatgagcataaaagaaagaagaaagtctaggaaagtgtagcccacatgcgggtgcataaggcatatgaaggcggtgcacgatgggctatggggtgtaggtggactgcggaacgtactgttacaggagcgtccacgcgctggacattgctctcttcaaccaagatctcgcgagccttcaagcaaagctccttgacctcagcctctgtgatgattttgcattgaagcagtgtctggatctggcgatctagatcagatcccataaagaaagccctttgacgtgagagtaaggttgtgggggtgagtgtggggcaggaagaagtagtggattcgcccgaagaagcgaagcgctgaattgcaaaagggtggatggaggagggacgaaggaagtgaatcgcatcttttgccgccaaacccaaacggcggggttgctgtatgacgtttgtctcatgtatatcccaacacgctggctttaaatgttgcctcatcaggctcaaccaaaaagcattgaaatatgaatatatacaaggtacagtgctgcctgcaagttaccctgattgaccagcaggcacgatagcccagcgaactgggcgtagtcttgttgctaagcagcgtcctcggatcagccgctttgcacggtcgcgccgcatttcacgggccaactgcctataaatttcgccgaagccatccagagaaaaacctcttctttccttccaacacaacgccactgccatcaagctaccctcctgtctccactcctcctacacgttcaaccacaagctcaacatagcgctcgccacataggttctcgacacatcccctcgatcccctgccctccacctctccccccacctctttccccccagaaaccacgtttttgtccttcgcactagtggacactatatttttcttgtgcccacttttacgcagcgctccgtgcacgacagacaacaaaacgaatatgatcgttgcaaatccttatgccaactcgaccttggtcatgtcccactccccgggcttctggggtcatcctacagcatcaggtaagaggttgttcgcctctcactcactgccaagagagtatagtctttttttttctgcttgtctctgaacagtgtcttaacgctcctcatttttttttcttgtgcaattttttttttgtatagtcggtaagtcagtcttcagtcaccctgtcagtcagacccctcttaattaccacaaaatcgagacacacgcgacccaactacaaatagctcgtctgcaaagaaaggagcagcaatagtagaggcgcagaggatctcagtccactgcacaaagagggaggcaaaaggagtgaggccatgaggggggaaaggaaccacgttcaacatggtactcatcagatccacagcagctttgtcatctgcgcaaggccgacaggtcaaaaacacgcgctatcacacacacacacaaggacaaaaatgggcactgggacagagcagcagacgacagcggttgattgatcccacctgcgcatcgcacatgcaaccgttcttttccctctgcgctcttttttttttttcgtcatttctcttatcctgacatggctcaactatggacctaatttccgagcggactcagcaaacagcagcagggcagacatcacgaaaaaagggggattacatgcacacatggatctgacttgcatgcagcaccactttgtgtcatgcagcggagtgttggacctacgaaaaaaaaaaaaatagcacgcgggcgtggtacatgatcagcgcatgtacatttgtacatgtgcaaagtcatttactgagaatagagagtgagcgttcgtcattgattatggaccctgctgtcgagccgcagaaacaatgaaagacaccgaaatagcacacagaaacgatggagtggtggagaggggatcccacatgatgacatcgctaacctaacctcttcattatcataccgttttttttttgttctccacatgtggtgtgcacaaatcctccctccgactcttcgacttagattggtgcgagagcaattatgacaagtcgcattacatcgccgagttcttcaactcgctgtcgtcgctctccatgatcctcgtgggtctcgcgggcatgtacctccactcatcctttgagaagcgcttcctgctcacgttcgggtcgatcgtcatcgtcggcattggctccattgccttccacggaacgttactcttcccgctccagatgctggacgaggtccccatggtctattcaatcctctcactggcctactgctgtgtcgagaacaaaccctaccgccgctatggtgtctggttccccatcagcattgccctctacggcctcctcacgaccctgatcatgctctttgcaggtcccgacaaccacctgctagagttcatcgtcttccagtcctccttcaccttcatggtcctcatcgtcatgtcccatatcatcaagatctatggcaatctacgggacacctccatcaagcgtctctgggccgtgacaggagccatgggtgtggtcgcgtatgcctactggaacattgatttccggatgtgtggcttcgttcagaacctgccctttgggatctggaaccctcagttccatgcttggtggcacgtcggcgcctctctctgctcctacatggtctgtctgttggtctgctatgaccgagctcagaaccttggccgtgatcccaagatcgagtggaaggcgggtctgttgccatatgttattgctcaaagtgtaccctccatcaaatccaaatacaattagacacaataaaacatcacaggcttgttgctcgtgtgctttggtgtattttttttggtgtattaaaattagtatgatacatgtattcctctatcacgactgaggtgtggatgtcgtggtggtcgttgtcgtggtggtgatgatagtagaagaggtgaaggctgtggcctcctgcaccatggcactgttggctgaaggagaagccgcagcccctgccggctgaatggacgatgcgggcgcagcaaagacgtcggctcctgaggtgctgctgcgctgctgatgatggctcacttcccgaatactgctcgcctggatactggatttgcttccattactccgatgctgtcgctcacgacgctcctgccgctcctgccgctcgtgatggtgatggtgatggtgctgcccttgtaatttcgagctagtcgtcaggagtgtcgatgaagtcaacattgaagtctcaccgccaccaccgccaccacctcctgcacctcctgctcctcccccagactggtcccgatcaatctccttgtcgagctcctccagttgacctagcacaagacccacaaggtggtcctgtctctccacatcccaactcgctctctccagctcgaagcggctcttgcgtcgggcttccatcaatcgatcctcttcttgccgcagccgcttggactcatcacgataccgctgtacctccatttcgatctcaggcgcccacgagagcttggtcacatccacgaccgcattcataatctgctgctgctgttgttgaagaagctgctgtggcgctgcctgtgcagaggctccttgagtttgtccactttgtgagtttccggggccattctgcccgctgtagatggatgaggacgaggacgacgtcgcgaggccggcggacgacctgtaaggggatccgttataatgacctgcaccgctgcccactggcatgttggacgacgcatgggctgccgacaagttggataacgaggacgacaacggcaccggtccagaggcgtgtctgctgaggtaaggaggacctcccatgccgcctctgcccgccgtcatggacgggtcccgttcccgctctcgctctcgatcccgctcccgttcacgttctcggagctccctttccctctctcgctctcgttctcgttcccgttctcgctcccgttctcgctctcgttctctgtcacggtcatgatcccgctctcgctctcgctctctatcgcggtcgcgttctcgctcacgctcgcggtctcgatcccgatggtccaagtcgtattcaggaatctggccgggttcgggactcctaggtgcggcaaccgctgctgggcggtccagagacgaagcaggggctggtcctggtttccgagcgccttcagctgtcggagaggccatcctcgagcccgatgaagttggccgtgctgccgaggcggatgtagatgtggacgctggtggaggcggcagctgatggggcaccggtcgccgtgcaggtggaggaggtgggtgcgcatgagggagtcgaagctggttatgaggtgatggtgaatgatatgaagaagaagtggagccatagccgccgctgacatgtctggaccgtggcggtggcggtgaaggcctgtacggatgatagggctcgttgccgcctctggcatagtagtctcgctctcctctgtagtaaggatgcggctccctggatgagtagtaggacggtggcatgtgtggcggggacctatgtgagctgctgccgcggtagtgaggatcgcgatgatagtctgcagaggacaatgcgtagccggcgtccgtcatgggcgagcgagatcgggtgcggccgcccgtggtgctgcttgggggtccgcctgctgccccatagcgctctgtcgacgatccgcgacgatgttctcctgatgctcgcgagtaggagccgtgtcgttccatgggctgatggcgttggcagctgcttgcaatggagaaggtgagtaatgggaggacagatgtcaaagcagcaagaaataacaacaacgaccagcagcctgtgactgtctttcaatggggcctcagctcttccaggccgctgcatcaaggcatcatccagctgtcaaatattttcacgcaaagcagtgtgggtgcgataataataaacataagtctcttctatgatactctacaagccaatatatagtgcagcctcggtccgaccatctgctgcatcatcatggcacttaaaagtcctcgaccaggccgtgctcctgtctgtaagcgataatgtctgcgatggtcaccaacttgatgccgtactcctttgcaaacttgtagcagtcgtcacgacgggccatggatccatcccggtcattgacaagctcacaaatcacagccacaggctgcaatttggccagcttgcacagatcaaccgatgcctcagtgtgtccgaaccgacgaatcgtaccaccctcggcatagcgcaggggaaggatgtgtccggggcggttgaaatccttggcggttttggtagggtcggccaatgagcggcaggtcaaggcgcggtcgtgggccgaaattccagtggaggttccatgtgcatagtcgaccgagattgtgtaggcagtcttcataagctcctggttgttgggtaccatgaggggcagttccagtgcctcgagtcttgagggtgcagcaggcacacagacgtatccactacaacgtaaagcagcaaaattgtgagctaaacatcctccttcgagatgtgtttgaaaacgccatttgatgccatctggatgtccatcaagcacagagcggctgtcgaggatcggcgcatacgaccatggaacttattgcctctacaccctcgtctctccgatcctgccttgattctccatcccgacgctggtaagatgacacaatctccacgatccagacttcctgagctcctgagctccgggggtaggagaatataagtccagcttttcttgagaagctctcttacctagagtgacggataaggaaggccatctgctctgtagtaaccttttctgcggcgatgatcaagtcaccctcgttctcacgatcctcattatcgacggcaatgatgaattttccatcagctagaacggcacacaaaagtttgaacagatgaagtgatgcaacaaaggtcgattagtcgagatcgatttgcatccgtctcaattgcatcacttcgagagctaatgaggctactggtgtctcccggtgcatccagtcaatcaaaggagtcttcagtcatgcaaggctcggtcgtgctgaagagaaagaggagtctgatccggatcggccctgatagtgttcacaatagttcccaaaatgtggcaactggcatagactatttaccgatgtccttgatagcatcctcgatcgaatcgaaccggacgtctgggatggcctgtaccatggtgttgtctttataagggttacgagttgggtatgcgctggtgaggatgctgtgggttgtcgtgaaggagtgtcagagtgaaagaaggttgcagcgaacatagcgcagccggacttttgacatatggaagtgtggcttgttacgaccctctgaagagtctgaacttctgtagaagtggaaattcaggactggtgtgactcaaacgaacgcccgcgctgacctccacgaggtcgttgccagccaaagatgcggatgcaccgcccactgcagcgctatttgactggcctggacaggtagacaggaagggcgggccttgcagcgttctcgcttcgatgcgaagcagcagcagagtatgggcaagaaaatacagtcgatactgtcagtacccgaccttgtaccgtgggtagaaaccgtgggtgattgttacacgcatgcattcacaagactcggacagctggcacatgtttttcttgttgtccgtccagacccatgtctctttgcctctttgtctttcgaatctgcatatttccttgccaccccctgaaatttggttctcgatcgatcgccaagggaaggacggccgggtagttttactccgttacttggtcaggattctctccgtggtatcctcaatcatgcgcagcccacagcccatcacacagctgccattgccatagtattctgcaaaggtctctcagtgcatcatctctcacctctgcagattgaagccctctcccccctggatcgaaagggacggataatgttttccccacctgcagacccaccggatgtctgctttgtcatgaattggcttccgcagacgcagaggaactcacgtgcgtggagggtatgccgaatcgctctcggatcacaaaaaaaccttcctaacgattgtccattcctaaggtgcagtaaggggtttagaggagtctggcaatctacatgtacttgacgccacgtgcaggcaaaaagctttgttcagcacttccaatccgccttgtcggttccataaagccaatagaggccaggctataatgtgaaactgactactggctggaaaaaaaaagatgctctggactttcactcgcaaactacaagcacgagcggcatagaaacagtgtgatcttggttcgattcattgacgaggtgcggaacggacaaatacaagagtaataaattgcaccactctaaatagcgtaagaatagacggtgatggttcagcttagtactgcagagctacaatagtcgattcggaaggtccaggttgtgatccatctgtccacataggatcaaatgtcagggtctgcagatccaatgagagagaatattgccacgccaatgatattggcaacaagcgcgcgctttgtgcaagggtgcacatcaagacaggagcattagggttctccccatgaaaaaaaaagatgaggaaaaacagaaaccgtaattctcagcaatagcaatatttcaggcgagggctgcgacgtgagcaatcacatcactgggcggtgttcgttatcgaaccttgaatgcagcatgcttggtaaacccaaaccgttctgagcttttagaatggccttccatactgttgatgcatgaatctcttgaccgcgatggactagccagatcgctggttgcgattgttctcaaacgcctataaacattgcaatcgttgacctttctcctctgcctggcacgtcatgtaatgcactgttgcgcatttgtttatcagcctcgccccagggaagcgagcccaaagaataatcctttacggcacgattgcttcaagtcctaagagcagcaacagagattgtggtgttgattatcgccgtgcagaaccaagtcgagaagggcatcgagtgggagaatatgatttcatgatggcgtaaaccccctcccatccctttttttccccctgatcacttctcatttgagaagtctcgcactgtgcgtgcagagagaggtgtagaaaccatgggggaacagtagtaccgtcgagtgctggaccctcagtagcgtatagtctttacattgcgtattgtgcatgtgcagtatatcgtgaggaccgtgttggtcctttgtgtttctattctaccacagtacatgcatctgttttcgcttttgtttgcttgtttgctcgagggacggtgaatgctgcacaaactgtagcaaagcagtgagcatgtctggatggatgagcactagtgttcaacgacaattaactttaactggcccgtccggcatcccattccgctggcgctctctcgaggcagcaatacggcatgtgcatgtttgtgtgtgctggggagggcaatcgagacattctctgattcaatatattttttttacaacagttgccccaggcaagggacacagcaaaaggcaccaaagggcgcgccgtgcatagtaaacaaagaacgtgctccgataccaacgcgatcatagaccttgcactcatatctttttgctgcaggttcttttttgtgtgccgacgtagatacaccccagaaggtacttgaactcttaaccggctcatgcatgagaagtggttcctgggaacttttacaactggatcgttcaagaatttaatgcgtaacagtgtggcgtgtgtccagagtgcggctacacagagcgtggcgcttcctggttgaaacaaaggggaaagaaatgctagagttgtgtgatattcagggacctgcgtgggaacatatgcaagcgaacagccagcacggttagaaaaaaagcaagtgcgttagggactgagtcgaacgcagccgtcctaagctcaaccaaaggagcatgggccccgtacaaatagtcatggctggcatcatcatcatcctcatcgtgtgctgttccgcggtaataactgcttctgagtccatttgtatacatatcgaagtagagtggtataatgctaagcaaattgccctgaaccctctctttacctgttagcgctgctggccctgccgctgttgctcacactattgaccactggacaaaatactgtcaatagcgcgcaattagatcggctgcgttagatactaaggaggcgactggcaagtacaacagtcgccgtaaacgcaaagggtgtgtgcgtgcgtatgaagtatattttttttttgaaagaacggtcagacaaaaatttttcctatcaattttgagcctgcgtaggttatcccttccttttggtctagcgttgtttagttccttccatatacctgatccatgcactcagcaacttgaactccagccgactccacttttcttgtgcccgttttgcgctctcgtccttcaacatgcatgcactattattgaaacgacctgcagttcctccgcccgttctttcgcatacacagtgtttgtacagttatatattgtatcgcgatatccaatgatcttcatgttcacacggttccatggaaggtgaatcaaataacaggtatggccaagtgccgcatggaacacaacgttgagcggctggtcctttaggacgttgaaatcgacttgatcaaagcatcatcatccatgcccacaaatcgaagcaatccgagactgctgtctcaccgcctacaggagtcatattacctcacaagcgcatggacatctcataccttcagaacatgccctcggtattgcggcataactcctggaactgcgtaaagtgatgtgtggcatatgcaataccactggtgaagtacacggccatggatcaggtcaacacgagggcaaaaaacggggtcgagcacccatgtagactacctcaggatcagcatgctgcaaatcccctccccaagcacttggcagccgcatcaagaaacaatattttagtgttggaatatgacagctcctaacgctgcctaggctgacctagcagatgacagatggatcagagagtctagcttggcgtgaagatcaggccttttgcacatttattctggccaacggagcaaagaaagctgaggcatttttgccttggcgaggtcttttcgagttcttataatctgttcgcggagaagacatgatgagcgaataagagagaaacaagataagtagtgatggagagagctagagagtggatggtcgagttatgagagatcgagatcagaggggagggatcttcgatatcactgacgcaaaatcaaacagtggcacggcccgagttctgttgcgattgagctagcgcattggcaaaggatgaaagccaaggcagggggtcaatagcgcagtgggtgctgtgaaaacagagatcgttgtgatcctggagggcgctgctgctggcggactgatttgccggcacgcatttaaacaggccgtgagctggaccaggagtgtataaaaaaaaataaaaaaagaggacgggctctcatccacctgctcccactgtctctgtcaacatattctgcgctctttctttcattctttgaaactgtgcaactggactgaatactcaataagaatagcatatcatctcgctccattcctgtggcaccagcccgtccaattccccttgttccttccgtacccttattctaccgttgggcgggccatcaatgccctccgctgcattattgtatgtgtatctctctatgccatactgtacatgtacacaacaatggccgttattgcactctacagtagctagactgaatgcgtatctaccagagtaccaaggcgattatgtttttaacgtttggccctgaaggctgcagctccccacaatgaactgcagacaacagaccggcagagacaaggccaagaaactcaccgtctgcacccacacaaacacatatgaatgtgaggctgtatataaaaggctcgcacggcaggcatcgcagtggcctgcctcctctcttttacccccccttccccctcgctactttgctttttgttgtctctctttctctctctctctttttttttttaactcttcttctgttttcttttttttttcggtccctctctcgtccctctcgctcctcctctctccttcctggccccctcctttcccttgcatcgacgtccttccctgcctcggcctcgctcttgcccttgctcgccgtacacaaaaagcatcaaaaagccgcacatccacgttcgctatccgtcccaccctctgcaccgttattgctcccctggacttcctccggccgcaccgcctgctcctttcctccccgctccagcccgctcgttgccaccacccttgctcacctctcttccttgttccggcgacatcgtccctccacgccagcagcatcgcttacgcccactttcgcactgtgttcatattttatccgtacatacaccagcggatagagatatactttttctccctctacacaaacaaacagccagactcctccctgcttcatcgccagctccagtccacatacccacatacgcacatacttcgagccctgtacatctggccgagtgcacttcggacttttagtaggaccaggtaagctttcccccgctctgcgacacagtttgtcgtcactggcactcgtctcaccgctgcctacactcgaacacaccctcgcccacatacccctaaatcctcctagacagctaggaaacatgcccaatatcttcacgacctcgttctcattagccatcagctgtatgaggcgacctccccccgttccattctctttctctctcattgctcaagggcaacgtcgagactttgtgaaggatctcctttattttgttcatactttcttggacttcagccgcctgcggatgcttcagatacgcatggtcacaccctctcgaaatctgctctttcttttgcatcacactgccacattctaaacttattttccgttcggattaatatcacaagaaagttgcctgtgctcattcctgctcttcatccatcctccactccccttgtcaagcagcgtaacgccaaggtcgataacattgcatcagaggttcgttcaatcacaatgatatagccatttgctattttattttacacgcttattcataggacttgaagatcacgatggtcacaccaagggcgggctggagaatattttggcgttctcgcaatttttacacatcgttcatcctggctttacacaacagaacatgtatgatgcacatccttcccacccttgcatgcgggcccttctcttgtgtgttgatgtgcgggttgaaatgcctttttttgttgtttttgccctgtttctctcgtcttttcaacctttatgcacaccaggaacatcatgtgtgcatgttgtaacaatggccaggccggtatgggccaagcagggttcactgatggtcagggtcataattttccgcaatgaacaagaaagaggaagggaaggcaagggtagtccctgacaccatgcgcggtgccctgaaaataaccctgtgctgtccttgagtgggttgatttctttttgcatgtcgggtccatgctctctctctgtcgcctgcaaatatatgccaatatcccgccctcgctctctcactctccttgcccctacagtgcgctctgcccttgttttcgtttgttgtttgtccgttttgttgttgtttatctccacttcctttttctccctaccgcgttgaatatcacgctagggtcctctctcgcatgacagggaagagttcatgcaacaggaaagctgctgcacttttggcgcgcgatcctctttgtcgtttttcttgacatgtaacaatcacaacaatcagttcatattctttacttgcctcttgtactcgcttaccgttggcgtgtccgttccacagggttgcgcgcgtggcataagggtatacagaaaacaaaaaaaaaatgtgtcctcctacccctttgcaatctctgcttttgtttttcttcactcggccctgtttgttccttgtcctcagtagttttcgtgttctatgtggggtgtgcttcaagtgatgctgcatcctcaacgcttactgtcttgttcttttagttgctgctaggcctcactggtaaccgcttacgccaaccattcctttgctcttctcgatcattgcagccgggctcaggcctccccaatttctcaatgttttttgttgttcctgcattacatcccgagcgatagaatcgttcctgattttttttttggtgtcatcagtgggtgttccattcagctatggaactcagtcttaatctccggcatcttagacccacccgtgtgattctgttgtccaaacgcctaaatgtgtgggctgcggttctggaactccgagcaacccttacctctgcggctgtctcgtctctctttaaaaataactgggtggatgcgaatgacgcgttagtcaagcgagccaagaattgggaggggaaaagtggaacatcttgctggtgaggtggggtgctgctgttaatagtgaaaaagagccggggttgtttgttgggatggggttcaatgctccacggactggcctttattccaggtgcttgttggacagatagcctcaagcttgaagtgttgacacctccgtctcgttctctccttgatttaccacgttttatttgtgccctttgcagtggagggtgtgctctttggccttccttccttttgagaaaacacattccattttactcccttgattttttctttcttctttgcgcccggccacttcagtgctctcatggtattgtctcttaggaaagatggagagggaagacgaagaggagattcagagcgaaaagaacaagaggggatgtgagctaggtgaggaagcaacgcagcctcgaggtataccccaagggtgtttgcgcgtgcgtgtaggcgttagtatgtctgtgtgggtaacagatgtgtattgcgaatgcgggtacatatatgcgcgtgtatgtatcttttcaagaaggagtaaaggagggagaggggtggggggagagagagagcgaaagggtgcatgtatgtggtgcgtattgcacgtccacggatgtgtatgcatgtgcatgtgcatgtgcatgtgtgcgtgcgtgcgcggaaagggacagggagggaggaccgagagaaagagaacgatgggtcgagcgacggaagggacggacggatgaacagaacagaacagacagacaggatacagagagaagagactgagcgcgttgctgaatgagggaaagagagggggggttgaatcgaggggttgttcccttttacaccatccctcacactttctctgttggccgcatttatctgacaccccccatgccccccccccccccaccacctatccgtccttgatctcttctcctgttcttggaagaagacgaaaagccatgcttgttgtttcttgcgtttggctagctctctcctgatgtgatgtggcctctaggttgggcgagtgaaaggggcaagctagctgaagaatgagtgatccacccatggacagcaaacgaggactagccctcgcttccacccccccctcttctccatcatcatagtcatcatcgtcaacatcgttgtcgatgggccatcgcatttgtgtgttttcagttgttctgctgttcgatggctgtctcactgttccctttctttccctctctcgttgcttccttctgaacggacatctgtctctacacaattcagcccagaccagccctaatctaacctctccagcacacccttacctaacctggcctgcactgttacacagtctcaaccagatctgaccctcatcgtcgtactgacctttcatccctctcttctctcgttaatcctcacatcacacttgtgcatctcttttcccctccctcttttttttcgttccttcctcgcctcgtcttcacctgttctgtcgccaatcgtccttcctgcttagcctgaataggatagatcgtcttggatctgaagcacgtctcgcgtcttgcaaataccaaaaaagaactcgcaaaggtcccctctccgtcaggcactctgggagcccgctttttgcacctctggagccgacccacgacccagcaatccttaatttccaacgagcatccatcccaaccccatcaccccgtgcccgtttcccgcgctcctttcgtcgacatctctcctcgtgcagccaaaccagctcatcagctcgttgggcctcgtttctgccttgtgcgctcttatttttttttattcatattcctctctctcctggcgcccccgccagccccgcactcctttgtcatctcgccctacagaggctcgaggagtccttccgttcccaggattcccccttctcctgcactcgcactctcatttttttaatattaatttgagcaacgagccggcctcagcgacacgttgctgatcaacctggacctggatcacgacctgaacctgaacctggccctggataatcccttaaaatccttttttttcttgttcgttttgctatcgtccctttttttcattaacagacccctcctccagctccccttctcctgctgttgcgctcttcgttctcgtccacgcacagtgaatgggcttgtgtgtgccactgccctctcctccccattcccattgagcctgcactcgacgtataaatacagggccttcttcctcggagaaccatgtccaccaccacctcaagttatccgcctcagctctatcagtcactttacagtccgctgagtccctcaagccaacagtcagctgcccttggtcccccgcgtgcgcccactcaccgagcagagccaccgactctgtcgcacactcccgcgcacccgcacaccttgctgcgaaaggacactgctcctcacactcaccctcacactcagccgcacagtcctcacacctctcacacttctcactcctcccactcctcttactcccacacaaagaccgcctctcgctcgctgcactccgacgcggcaccacctccacacctcccaacggcatccatgaccgacgccgcggtgaaccagcaatccaagcggttggctggattgtcaatcaccaactcttcaggggccaaagtcagcattctcaacgacagcccgctcgacctcgacaaggcctccatccacgatgatgagatgctcccgcaccagcaccagcaccaccaccatcagcatcagtcatcacagcctccaccacaaggcacccggccgcatctcggacacccagactacggcctgcctcctgctcgctcccctcgatctccacactttcgcgaccaccgccacggcagccgcgactattttggcatcgacgaacgtcgcgacccatactacccaccctccattcatagctcctcatcgtccagtcaacggtaccggtccgagagctatgaggccgggcgctcaacgtccttgacgaacgccgcgactcccttccgatcgggattcgactccctacgcggagcgacggacccagcaaattctcagaggagtcgcagtctgagcagtggtgcacagttgtatccgtatagctccaatggccacccaggcagctcggcgtcctcatcagcggcaggatataccccgaagggaggagcaacaccaatgccgtatttcatgcgggcgttctctgaagactcgacctccgatgatcatgatccgtatcgcgggtacattggacatcctggactgcccgagggcctcattgcagggtcgagcttttcgaagcgcaagtactcgtgtacctatcccggatgcaataagcgcttcaccacaaggtatgcccggtgcccgtgcactggatccaattgatgcaaatgctcaattttttttgcttatcttcgataacttatctttttctctcttttttttttgttctttaccgtagtggccatctggctcgccacaaccgcattcacacgggagagcgcaacttttcatgtctgatgcctggatgtcccagcaagttctcgaggcaagacaacatgatgcagcactatcggactcacatctctcccaaatcccgccgcggcgtgagcaagaagcaagatcaacaggacgcagagagtccatccgagatcaacgagtcggacgctgtagagtatcccacgacgccacagcagggacattcaccttcagcgctgcctcctacaggcctctcgcgccaaggctcgagacacagctcaccccctcgactatacccgtcggatcatcataatcaacccgaggacatggaccatgatgatgactcgcgcccctcctccaggcagacgcaccagttctcaccgccatctcacggctccgcgggcgaacaccagcggtccaacacttggtccgttccagcatcccccacctcgcccatgacgcaaggtggtgaccgtatggaggacgcacagtcatcaacatcatcgtcgtctgcatcctcgtcctccacacgcgatcagcagctgttctactaccgtcagcaacagcagtatcaacagcagtaccagcaccagtaccagcagcggcaacttcagaagcaacagcagcagcaggctgctagccacgcttctgcgtactatcatgccgctcagtcgcatgtgagccatggccaccaccacggccacagcagccatggccatcatggagtgagcaggcacctagcctcgccttcgtcctcctcagcgtcatcgtcagaaatgcatccccacgcgtattcgtacgcgcactcgcaggcggcttcgtccgaacgctcgggtcatgccagcggtcgggctagccatgggaaccacactctggccatgaacatgaccccaccttcgcctcagtccaccccagcgaccccgaccaagtaccggtttgaccctatccaggactgtcttcaacaagagcgtcgtcagcgcgaagaggccaccttgtagaaagaaaagatcaaaagacccaaaaaaaccctccgaaagataaagaaggagagaggagaggccaagaaggcctggcaattttatcgtattttttttttttcgttcaaagaatcaactggacgcaaagaaagaaaaagagacgagcatttcgatgtttctttttatcccccacgttcgtttgtttagaaatgaaaaaagcgcgtctttagccttagtaccccttcatacccagcctaccacttttatagataaaggaatggaaaactcaaaaaaaaaaaaaatgacaccagtgcgatgttgatgtacccttgagttcgcaacagcgtgtttctaagaaaaccgaggatgaaggcatcgtagttttactcggacaatcgtgtttcgatgatactttatacaatcttttttttttttttttttttttttttggtggtcgggtgtctttagttgagcatgtcctggatagacatggctcgacgcgcgttcgtgccttcgccgtcaccatcgccatgctccccttcttcctcctcgtcatcatcgtcctcctccagctcatcaaattcactaccgctactgctgcgaatgctgtcgtggctgctcttgagcgacagcaacgagtgtacactttggccatcactctgatcgctttcgagctcattctcatctccgctgctgcccgtcattgattcgtcctccgcgtctcggaaccgacccagtctatgcatctgctgctgctgctgccgccctgcgatggccatcgaggccacatccagatcaatgtccatcgcggtagaggaggactgatcaccggaaatgggccctgcaccggacgaggtcgcactagtcgcaacgactgtggatggtctgatccctgagacctttgccgctgctgctgctgttatcgtagctgtggctgcggttgtggccgttgctgcctgccgtagagtgcccaagtctgtgagactcttcttgggccttgaggacgacatggcctcttccagaaactcgggcaccaagacccaatatccgcctttccccttcgtggcatattcaagcacctgcgcttggtcattgttttcttccttggaggaggaggaggatggtggcaggagtacgagtggcggtgacggtggtgttggttgttgcttagattcatctttctcatctgccgagcccgagcccaggggggcggatttgatgaccacgcggcgaaaacacttgttatggctcagattatgtcgcacggtattctatgatgaaaaaaaaggagatgcaagcggtatgcatgattgggtgagtacaatgaacacaatcgatgcatacgatgcactatgataccaaggtcatccccagaaagtggaatgtaagaaaaaagaaaaaaagaaagcgcaatatcaaagtgtttgacagtttaggcggcaatagtaataatactaaaaaaaaaggttgggcgttcagccgcggtgttgcaaaagactttttttttttttttttttttttacctgccatcccttgtcgtcgccattcatctgtggtatctcccgactaacataatcatagatgtcggacaacttcaatcgctgaagaggtgagttacgaatggctttgatgatgatattcgaataagattcgttgggtcgccgcctgcgacgtgtcgtcttggtaccactaacgattggcgctgttgatggaatggccacattgaaggatgccggttggtccaggactgttccaattggttttgctgtaacggacggattgataacagtcgccatccctgtcagcgcgtgttcttccgaacctggcatttgctcatagcccatggagaatggatggtgctgtcgggtatggggccggcttctcggttgctccgcgtggtgatgttgatgatgctggtgaagcggatggtgttgatggtgtgggtggtgaggcgatgctggattcgagtgcggaggcgggacgaaatattgaacctgggagaccgggtggatgggctgggggttgctttgcgatgcatggtggaagtaatatggagtttctcgctctgacgaatggaattgctcctgtgcaagttcgcttgcatgtccctcctggtgccaggaatgtggatggtgacggctagtttggtgtgggtgtgagtgctggtgttgtgcctggggtgcgtgcctgtgatgatgatggtgttgaaaacgggcaggctgattgtaatggctttgaggtggtgcatccatatcttcaagatggcgtattacgtggtctttgggattatgggacatccttgcacgatcttccgagattgacaagacagagtgcgaaggtagtgtggcgtcgaacctcggtaaaatctcctgagaggagtggtgactgcgttgcgtgagtaaaggcgagagcgatgaacgttgggggcgttgctggtcctggctctggctctggtggtactggtggtactggtggtgctgttcgttatgatgaagggctgtagggagttgtgatggatctgaatggtgaggctgacgagaaaagtgatctggccagctctcaagtgtagtagtgtccccttgttcgtggctaaagacagctgagccaatgccgtaatcctggacgcgatcgaaagattgaaagtggtgatgggttgaagttgttgaaggatgtctaggtgaggtctgagtgtgcgtgggtgagtgtgcggtagaatatgacacaaactcagccgatgctgttgcggaccaaaaaatatcccgctgctcagacgaggcaactgatgagagtgaatcttgagatgtaaaatgggccgaggccaaagttgaaggtcgtggcgaaagcggtgagagtgaggacgaggaacggggagaagtcgcgctgtagggcatatatctctcttgaggggctgatgctgaaattcgaggagatcgatggcgaatgctcacatttgtgcctgccgaacgtctccttgcggtgcttggacgcgaactcgtcgtgatatagcctagtggggaggaggtggacgcaaaaagcagagcgtagacaagaacagtgtgcaaaacgaggtacgagttggaaatcgtgtttagtattggatatcacagttattttaagtgtgcattcgacacgcagagaatcgagacaccgaggcaaagcaagacaaggaggtttctggacgtatgttgatatggaaagtaagggggattgtcggtcgagggtggtttcgccgttctcccaggcgcgcgcctcgttgctacgcgcccttggcgttgctgtaaacgccaaaggcggccatcacgggcctgacgaaacgcatagttgccgccggaaagggagaatagcaggggagaacacgagcaagaaaaagacatgccggtggccaaactcgaccaaccttctggccgaggcgggattgagctgcggacggatggtgataccgaagaaagaatatatgtactggctgcagggtacagagctgggaaggcgcagacgggtgcgttcaagtacgaacagtgacaaatgtaaaaatgtgggttacgtagtggggactgtggagaatgcaaaaatcgcctgcagactgtacaaggggcgatcccaggtagaggactgatagaacggaagaaaaagaagagcgagcgagggagagaaggactggggggtgggagggagaaagagtgggcgaaagagagatgtaaagagagagagagggtgagggagagagtgtgtgtgaaagaaagaaggagaaggaacacaaacgtaaaaaaaacaagacgaacgaaataaaagaccttgtttttttttcttgtgggtcgatgctgagttcgcgcaatggtggcgatggcccatgactccacgtgagtttcttgggtaatgcctcacacacgcacacacgctctctcttgctgtctcacccaaacacacagagggatgctgtctcgtctgtccgttcaccctcgtcctctctcattcatcgctcgattcattaatccgtttctctcgctctatcccctatcgttggcggtatctttgtctctggattggtctcatatttctgctcctccttgtaaggttatatgaacaatattcagtgtatggccgcctctcagtgaatagtaaaggaagcagtggtgggtggtgccgggagcggattttcgcaatggagcgggaggcatgttcatactcatatgtgtgcgatgctctcagggttgagatattattaatggtacaattcacaaaataacggaaacaaaacggccattgttacctgagggatggtcgacagtggaactgagcgtcacagaagtccgctcaatccgagcgcgcattgactttggggcgctcgtatggtcatatgccacagacgtgcttgacgtggtaattcgggggtctagacgtaattcagtggccgaggaccgtcgagaagggcttgaataggcgttgcactcttcctctgtgttatgctgcgacgaccctgcgcgaactgggaccatgactttcaacgtctgacacgcgctacaacacgtacgggtggacgatatcccaaaaggaaatagtcgttaaaatatgacatcagatgccaagtaggcatatgccccaaatattctgcagcgagagagaatagtcgcgaggtacatgtacatgtaggcgcaaaaagaaacacacagcatccagcgagagagaagagtctgggagcaggggcgcgataaggagccaagagccttaggttcgggctcaccgaagaatgtagaaccattattgaacaataaaaaaaaataaggcttgctcgaagtttgaagatttgaactatgagcaaaagggtatgggcattttataaataagagcaaaggcagaaccgacttttcacagtcgggagccgccgaggcggcacaaatgaaaaaccataggtgcaagtgggtggaggtgatctgttgtggccggatgatggagataaagcgacagcaatgaagagacaccaccgttgcgctttctttgtttcaggatctgtaccctggatttgcgggtgtgaaggaaataccgtgaggcataaagttgggatacgggctgggttccataaatagaggccgtaaagagggtccatgtctctgacaggatgtcggtctgccttaagagaacagggagatcgatcaattaaggctgtggcaaacagaacagagggacgcttttgtgatacgcggaagggggaatggatggggaatgagcaagattcggctcgtgtagcctcagcccctgtcgagaaagcggtgtaggtgcaatagcggaacgcggcgtgcatttaaggacaaggtttgcgggaatgggcgaatgttcccataaaaacatagacgagtagtcgacaagcatcgacagtcggcgtgtgacattgtctccgagggaaggagttgatgcaggatgtttcaaaaacaagggtggggacgacaaaagagcaggttgctgatgatatagcacgaaaggctgtgggagagcaatgctgttaatggaggaagcggatagagacatggtgatgagcgttacctgtgccagtgtagaaaatatggtttgaaggccgggtcaaagtgattgaaaaggaaaaaaaagtatggtggcgaagcgctacccagaattgcgtactattcagagcgaggttgctttagcgttttggaggtgagggatggatgtgccgcaaaaagtataaagtgagagtgaaggaataagattgcggctgggcaagaaagcgagggtgtaaagtagtgcagatgggcggcttacgagatgacgatgtacagcgcacaagaagggtgcaaagatcataaaaaggggagagtgagagagagaacaaacaagaggatcagaagcaggaaggtcgagagaaaatagggcaaagaacgagaggaataggggaatgcaaggtgacttaaatgtttttgcacatcctgctccacttttatttcagcaccctggatgatctttgccgttgccgtttatgtctattgggcgacccgatcaatacaggcctgatatgatatctagcgcaacccggacggctccctgctcgacgcgattggctggtgggaagggcctgtttcgggtgattaccctcacgagcaaccgcaagtaccagggactcgggcgggagcgggcagcagctggctggccagccatgttcctgagcaggtgcagaatcaaatgtctgatctggacagagtggaacagagggaggggcctgttttggttctgggtggaacttggcgacccctctagcccaattcctggatgtcgactgccgcctgcgggcggtgtttgtgtagctgagctttgaatgacttgtattgtctctcctatccacacttctgtgtcccctttttttttgttccctttttttttttttggttgcctttcctgttcatggctgttctttcatctcttgcagccttctccctatcatcatcctctgagctcatcaatgtcagcctcgcggcagcgcatcgtactctggagaatgtatctttggaacaattgtaaaccttctctgcagatcgtgaggtgtgcaaaaataacaaacgactgagacaccaggtgcagccaataatggaactgcaagggtcgtaaatggacgaagcattgctacgctgccagcggccccgcataaaaatacaataataataataaacattcgttgaccgagacagcagcttgtggagcggagggagcaaagaatagaactgcctccacctggaatttaagatttcgccatgcgttcattagttcgcacacatacatataacgaccctggcaacagcaagggtcctgatgtcgcgcggagaacgacctctcgtgatcaacgaaagcactccgtcaaccctccatactatgagtgcctggaggcgtcagagcacgcttgctaaaaaaaagaaagcagcttcacctgagctttgatagaatcagcagcgagttagtcgccgaggttcgctgtcatactgcgacgatgcttaagttctcgactctttcaatgtcgtagagcctcgatacactgcagcgtaccctggtttctaaaatagcttttatgccgtgaccaaacgcccaacttgaccaagtccgcggaagaactgaacgcaagactatactttgcaggcgtcgtacttcgacaacatgtatatgttttatcgaactctattgaaaagaataattcaagactattgcgataccagcgatgtccacaagcaaaaaaaaaaaaaaggaaggggatgcaactttgcgatgcaagggtttaagaataatcaacgcattcaaaaatggaatgtttacatacaaaaagtcgagagttgaaaagtggccatgtcagggaaaggaggaggttttgtcattgttgacatgacaacaaatgggcttttcttcaaagacaccctcaattctgcattgcatcctgtacgctcgccgtagaaggatatggtcaacattcgaaacaataagtgattcctgcatctacagcaatgcacacttgtggtttcttcaatttgatcaaccgatagcgcgctgaacgaaagaaaaaaaaaggggggggggacgcaaaataatgtcgtgatagagggcttgagatcatggtaagcccagaacaagaactgtcggtacgcatgatatagtccgatgtaaaccactggatgatctggacatagtgtgttgccgttgaacagcagccgggacaggaccctcctcggagcaagacgggctaacaacctgtggacaggtttgacacaacttcatcgaaggggtgctgatgatttgcagatgagaatactccgctgagctggatcctgcctggagctgcgagaactcccgactgctttcgcatactagccatcaatgcagcgtttagatcacttttcttcacagcaagtccagaggatggttgccataacgagtgtggctgacagtcaatgtttgttcagtctcaaaccttagtgttcgtcatagtcattttacatatgtaccctgacctcgtacgttcatcttgagagaacgtttgttctgcaagacgcggttaacaaagcacgcacgcatgcggggaatacatggttgtggtatactgtacaggccgcgaccagagcctagacaaggcggaagcggagggttgctgagagtgtctgacgcaacgctggtttctcaacaacgcctgtcagcggttcttccaattcttcctttgaaccttgttgcgaggaagatgtctcggcatggactaggtactgcgatgtgcgttctttgagccagaatacttgcgtgttgaatgcgggaaatagaggacggtcctcatgctgcacagtagagtacagctacccgcaggtgtcacatcttgaacggggtcactctgcatggcgttcgcttgcaacctgcttgccaccagctcgatcaagcgttgaatttgagcacataagctgcaagaagctgactcgtacgccaaaggcgtaggtgtcttgaaattgctgctggtgatggcaccaagaggctggctgtatcgacgccatacgcagtagtcgtccaaactccaattctaacaaacactgacacgtagtccctaggtggtgtttgtgaatgtgtggctccagaatgtttgtctatttattcaattaagaacagccggccactgtgtgccttgccatggccgcggctgccctcaatcacaaccggatgtaccttgccagagttatgaatcgcctcaagatacaccgctgcttgctgttcgccggtactcccgcgcaaactgcctccacttgccagtcgccagagcacctcaaagatcggcttgcgactacttaccccccaaggcgacctatcctgaccagccgttgagacctcccattcttgaatcgccttttgcacctcgaggacattacggatacatttctgctgaaacgaggctagtttctgggacacagaatcaggtagctcaggtcgcgcgatgatcatctccagcgagcgctgaatcaactgcatcgaaatcaacggctcgcggtacaagtttggagattccttatcgaaaagcatcttgctgggctgcagtgattctgcaacaaggtgggctatgatcaacaaaacgaggaaacacagacggagatagggtcaggggtcgtgccactttgaagcaaaacttcgttgtggacagtgccgcttacctggctgccctttgccgatgtagccacagattaaagactcgaccaaatggttgagctgcgactcagtcgcttccttgcccgcgaacaacttgagctgaaggtcatatatcaatgtcaaggctctctcagatgagactccatatgacaactgaataccgcgcgacacgatttgcgctgcctcctctcgaacatctgcttcatcgtcctgtagctgccatgtcaatgcctcaaagagtttgaggtacgcctccgtaatgtccacagaaggttgttcttggcttggtgccaagaaatggggggcaaaaaaggcgatcgactctaaagcggcctcgcgcaattgaagtgtctaagaattgcatgagcatgttatcaatttcgtatccatttcgcgctttccactgaaatacaacgttattttacgaaaaaaaacgtacctgatactcatcggcgtgcttataaataaacgccgcccaacgattcaagcagtcaatgcgcagtgatctatcaatagcgagatcattccatatctatcataccgttgcaaaagaaaagtaaaaaaagacgggttagggtagccctgtcttgtcacactccttttcagcttgagaatagacacgtcttggttacctgaacaaaaatgcctccggttgctggtaggatcgcctcaactaccgcaacaccgccagtggcctcatcatcaatgcgcatacacagccgattccaaaactcgacaatgtccacgcgagatccttggggaaagggacgcgttcctccagtgatggatagcaacgcgacctcgacacgtagacactccaagttctcctcaccttggaagaggatttcgatcaatgttgcgtgaatcgacacaacattgaaaaatgcgtcgacgcccgctcggtttgtctccaacaatgcctgcaacgtctccaatgtctccaggcgcacctcatagtcttggtccttcagcaaatccctgaccagctccgtagcttgctctttgtccagagcggccgtcactcccagcagagacgccgagatcatagtcctggccatcaatcgtcgaacaagatggcctcctacgtgttgccggtaggtctgcttctcctccacgagtccgacgatggcgtaatcgagaataaatccgcgaatagtcttgaagtgtattccactcagacgcttcatttcctctcgttcgctctccatctccatggaagcaccgtcctcagcctcgacaaaatcgcgtcccatccactcttgtcccaggacaaactctgcgtatatcgaaagtaccatccaccggtttagctgacaacctgtcttcagcacgcgctcacttacaggtccaaaactgtccgcgaactgcatcacaaatgcccggcgtaccgtcctgtcagcgacgccttcgccgaggaggtgtcctcgcagaagaaactggatttgtaccagcaatccgtggatttcgttttggcttatgggtgccttcaagcagccctgtagaacatccacgaccagggccatcagatccctcgatgcaatgagcggtgtcagcgcgcgtgctgccatctcacgggttttccagatagcacttgcagcacatcggcgaaccaacgccacaaacgctgacatgcctccatctacagcatccgcaggatccgcatgaaggctgggctgcagtctcgacagaagcgtcagcaccgggtacaatcctggatgaactcggtcttgcgacgcctcggtacccagcagctgtcctacagccacctcaagctggccttgcaggaacccgcaaaggccttccaagcgcgcaaacagctcacgacttgtaataccgttgatcgccaggtgctcgtcgcgcaccctcttggctccaaagacacggtgaagcaaggtcgagaaaagcatcactccacagttccggaccgcccacgatggcgatgaaaaggcccggatagaaagctccaagccttgaccaacatatggcagaaccgacgtgctcaactttgcatccataaacagccggcggaggacgttcatggcgtgaatctgcggtagatccacctgctggttagcatcggcgctaacaggctcctccgcaatggccatcactcgacgcatcaccatgggcaggagcgtccgcctgttgtctgaaagttcagcgttcacaatggccaagatacagagcggcaatccagcagagcggcgggtcacggaaatggaatcgctcaaaatcgaattcaagttctcctccagccacgtcctgggcaaagcagccagcgccgaatcttccgagttcaggagccgagtgcaaagagagatgtaggctgggaagaccgaggagaaggctccagggtgacgaatagtggtcaacagtcgtcggaagagcgccccagcccgatcgagagcgttggactcgagaatgccatcgactttgagggcggtgctgccgatggtagccttggacaggacgagctccatgagcgacgacgactccttgatagctctccagcaataactcagaatgacctggtgattaggtccgccactttgctcaaactcatcgcctcctgaggagctaatgaccgcgtcaatcgactcttccatctctgtgaacgtggcgggaatattaccctcgggcgaggggtttgagaggacacccatgacgacaccacatacactctcgaccaaactcatcatatccgcgtggacagcttgccacagcgggcgatggttggtcaccagaggagaggcataatcgatggaggagaagaggtagcgtagtccaatcaaagtgccatgcatggggtggtggtgggccgcatctagctggttgagttttgccttttcaagctgaatccggagtaggccctggaggcgaagggcaaagtccactattacgagtgaagaacgaggaagaacgaggattgatcacactgctattagactgcatgttgaatcctgctgtgataaagtcgacgtactgctgcgttgtcaagtcttacctgcaggaaccccggtctctctgatggactgaagcatcaactgatctgcggcatctccataagacagctgggtgttccagcccagctcgattgcatacttgacgaagacggtcttcagcaccagcccacccgcgtcgctctcgccagctctagtgctcttcaaccagtccaagccccagcgtaccaaaccctccacggcctccttcgattcatagcctgcgaatggagccttgaaggtcatgagaatatccagcgcttgttcgcgacagtgatcaaaagggtttagcagacaacccagcagtgtcttggtgtgctcttcattagcgatcgggagctggaaagggaatcgagaaacctctccaaccttggatcctggtggcaggggtgtcgaatcgataccaaatgtcttgatgaccataccaagtaatcgcagactagtcgagacacgctggaaggatgctcctgggtagatggatgaaaagaggtgatcctgcagccacaccaggaacgactttgtctcttccactctggcctcgcgcagctgaatcatcgctcctgcctcctcctcggtgaggttcttcttgcccactgaagtgtggagcctggcgatttcccttgctagtacatagcagtttccacggacccggaaaaggaactttgagagaagggtgtatagcttttgtcgaaaatcggggacgacagagttcatgttcaggggtagaaactgcttcaacagctcgtactcgacctgcgctactggggtggtcgagcgcttagactcgcaaagaataccaagtacatcgatcctgatgtcggccgacgcatgatacatggcggaatgaagaatagagatgtcgatctttggcttttccaaatcggtgcagttgttgttggctgaagcgaagtcggaataatggctggcatcgatgaggtccagcgatcgagcgaccttgatcgctaaaacaatggcgttgaagcgatatgcctcgtccgagataaatcctgggtaagattggccggagccgctcaggatgtccagcaaaatccagaatgcctcaggacacgtcgaaaaaagcggtgacaggataaagtggcccaggtgtttgcggatgtggtcgttcgccgttgtcaaagcttgagaaaccgactttgaccaaaagtcgagccaaggttgcatcgctttcctgcgcgctgcctgcactgcagctgaattattgtccgctgaactgtccgacgccttgcttgctgtgtttttttccgattttttgctcgcggatgtggacaaaacgttggcattcttggcatcctgttcgagacactctctccatgatttttcaaccatggcgttgatggcgacggcagcccctggcgctgtggcaagctgttccaaagctatgatcgcctgggcgagagcgtcctgctggagctgcataacctcagcgatgggaacacgtccgacgagaatagccaaaattgagtactttgacttgcggtgactgtccgccatcaagatgcgctgaagaagttgagtgacaaaggctggggttgtgtgttcgtcctgcatctgtgccttgatataaacaatatcgaggagcagctccaaaatattcttgactttgtgctgaacagtgtcgacaggatcctcccagtaatcgagaacataggtcgtcagtttttcttgtgcttgttgattgatgcagctcgccaacgcctgtttcatctctgcagacgccgaggatcggtcacccagatggagcttggtctgctgtagccagtgtcccatggtctcgaaagcgctcgtcttgctggacatgtccttggaggtggcacacaaataggcgatcgcatggaacagcacctcgtgcagaaccagcccgtttttgtgaatatcgttgaacactgctggagcgtaccactgggagacgtcctcgacgggcatcacgagagcttcctgtcgaatgttggtcaacaagccgcggacgactccaagcatgtacatgcctgcgtcctcctcaccaggcccgcatttttctccgagataggtgttccatccaaagtccatggcaaccatggcgcgaggaatttcgggcaggtaagtcagatcctggccattggatccaaagacaagtccaacaatgcgacgtgaagcctcctggacgctgggagaggtcaggtcgatgagattagcaaagatcatcccagaaatggaggacacatcccgatgatatgccggcgacgaagaaatggtgatagcgtccttcaaaatgcggatgatataaatctgtgggttgtgtttctccgagatctcaaactggttcgagggggaggatccatggacgggtgaaggtgatgctgagccgttggagctgctgacaattaggcgggagatcatggcgaggatcagcttaagaatgaactccaaatcgtgcatggcttctgtgtactcgcttggcgcatgatctcgaacgacctagtcaagtgaagaatgcttatctccggtgagttgacgatccaacgacacaacgcgcgcttctcagtcatggcgggttcttggagccatacctcgacgttagtgaactgaatacgcgtgtgcaacagttgagacagctcctccaggatggagtgcatgtcggcgtggatggcagctctgcccatagcataatccaaggtggtgtacaggcaaagggcgcgttgatgccatgccatatcaatgtcgattctcctgcgagtatcgatcttgaagatgtcgttagtgatgacggagcgcagtgcggacacgatcggtccatgtggatcagagtcgtttggctgcaggtgaggctgcagtgtttgaagtagggcaaagatctgtttccgagaggcgagcttggccgatccaaagtaaaagagcgccataaactgggagaatgcatgctgaaagtcggcctgcttcagcagttcgcaatcctgctccttgagagacttcacagcttgatctggggtgggggggggggggggtttggtggatgcaaaaaagccgtgacgggtgagctggacaaatcagatcaacctcttgatgatgttttcttccagcgagccacctacctagcctcttgaaggccgctgcctgctgctgcgaggtggttctgccgtacttgtcctgctcgtgctttgagtcgttgacgaagagcagccaggccgacaccaacggatggtcctttgcgctggcctcgaagggttcgaggagacgagaccagcaggcggagtagggcactgacaagtccttggactgaaaggcctgctttgttctctgatgcagcaccattcccgtcgtgtctgtctagtccccgactgatggtgatgtggtcgagggtggtgcgatggtgcgatgggtggagtggagtggagctgaaccaagaggccgctgcactgctttgcgaaacaaaatataaaaaaaaaatgccctaccgacagggtcgaacgtcagccacccaatccgaactacaacacgagcgcggacgcacacaccacacgagaggtctttcgaccgagcggccgattgaattcctcactctcttcctcacctcccatcatcatgaagctggttatcgcacccagatccgcaaagtcgcgcaagttccccatcaccctcgacctcgcgggggcccccgccgaggtcaaggtcgaggacgtgcagggcgccatcgccagacagttccctcagctctaccccgaccgacagcgcctcaccgtcgagaaggtcgcgctcgaggctggcaagaccctggcggactatgggctcaaggacggcgactctgtcaccttcaaggacctcggtacggcgtctgctgcagaaaaacacaacagcaacaacagaaaagcgcattgttgttgctttacacacgcaccagtaccagggataccagggataccactgtctaatcttcccctgcatactttattaggcccccaaattagctggcgcaccgtcttcttgattgaatacggcggacctctactgatccatcccttggtctactacctcccttcgttgttctacggaaagacgtttgagcacagctggatgcagacgtacggtacccgttaccgttacattacttcattgtttttaccccctttttgcttggctctaacacattgatgttccgtgcctcaatagcgtgacatactggatggtgatgatccactttttgaagcgcgagtacgagaccgtctttgtgcatcgcttttcccacggcaccatgcccttccgcaacgtgttcaaaaacagcgcccactaccatctcttgtcaggactcaacctcgcctactgggtctatggcccctggaatgctgccggcaccgccgctgccgagagaagcgacgctctcgtctacggctgcattgctcttttcgcctttgcagaactctccaacttccacactcatgtcaccctgcgcaaccttcgtccccccggcacccgtatccgcaagatccctcgcggttatggctttgactgggtgtcgtgccccaactactttttcgaaaccttgtcgtggttggccgtcagtatcctcactatgtcgtggtcagcccatcttttctttgccgtcgctgttggtcagatgtatatctgggctgtcaagaagcacaagggatatcgcatggagttttcggattatcctcgcggacgcaaggccatgttcccattgattgcttaggtcctttcgcctcgatgctctttgcgagcctcggtcatccgcctcttttcccaaacccccatcccctctcctcccattttgcccatatgccgtttcacaaacacacattgcagttcagtaaaaaaaaaaaaaaaaaaaaaactatttgacgatgaaaatggacgacatatcatatgtacactattccgctcactgctgagcaagaacgccctaaagaccaatcgcacggcagctccaatcccaccagaacttttgcttttccagatccctactttcctcgctcgtctctccgaccacgtccttgtcgtaatagaccgcgttcccatttcgtcgctctccgctcatggcgttaaacacccgcctgccaccctcttcctcagtcgacgcagcgctgatcctcgaaaggacattgttcatgagcatgcgcgtcgcgaagccagagtgacgcttgagctctgaagtgggaacgaacccgggtgacacctaagcattcatccccaaaagaaaatgtcttaattccacaagggcttggattgaacagggagaacgatgcccccccccctgctacaaaaaagaggatacagtagtatccaagctcttaccgcattcactgtaacaacatcatccttgagttgcttggccaaaacatgcatacacaggagctggcacagcttcgagtttctgtaggcaaccataccatcaaactcctcagtgtcgttgatgttctccagcgtcagaagggggccctttcctttccccacacccggcttgtgaagctcggacgaaacaaagagaaccgtcgtcttctcctctggccaggtcttgtgtccgtgacgaagcgaggggagcaaaagctgcgtcagaagcagctgcgacaggtggttgacctgcatgctgtactcgtggccatcgtctgccgtcagctcacgcttgaagaccatcacacccgcgttcaggaccagcgtatggatgccataggggaaggacgcgaccagggactctccgaactggcggacagacgcaaatgaagccagctcaagaggtcggaactcgatcgtattggagtcggcagcaaagccctcgagtctcttgataccagtcgtggcccgttcgtggtcgtggcagcccagaacaacatgcacgttggcgctcgtcgagagaatgagctttgcggcctggaagccaatgcctacgttgccgccagtgatgacgaagaccttcttgggtgtggttgaggctgtgggattcatctgaatgggcaagtctgtttttttagcgatggttgcaagtggcgaaggagggttgtgcgacaaaagagtgaagagagcgtaagaggaaagagaaaatctgataagattgcgaaatctcacgctgagaatcaaaaaaaaaaaaaaaaaaaaaatggagttgcaactggccaccccacgcgctccacctgagcatgcctccatatcacggcctcagcagagagtcgggtctcactctccaggtgaagtgaagaacatggatggcaacagagactggaccattgacctcagaacagcagcccacgtatgactttctccacataagcatcgcttttactcactgaaaaggagccatgcgagctgccgcacctggtgccgaaacaaatcttggcggagagacttcccgatgcggatgaagttgtatgtagaagtaaccctcgctctaaagcgctcgtattcatcgggtgtttgaggaaggagaggtcctgccttcacagtgcgaccctgcgccgcaacgcgagaagctttacgccatcaactgtgccattcctccatacagccactcctcctcctttgttgaattgcttccgtgtgtaagagagcggtcaagaggtgcagagtaaggcgcagagcaagctgatttaactctgcatcaagtgcagacattatttaatgatatgtgtagcacggctacttggtcaattcaaaaactccatctcttcctttgctgaccagttcctcgataaatctacagtatgtctccgtctgctcgccaggcaaggcgtgacccgagccctcaaagacaacgagggggcatccaagttccttggcaagatggtatgatcccgagggtctcacaaacttgtcctctgttcctgtcaccacgagcacaggcaatcctgaatccttgatctgagtcagtctcgcagagttaacatgatgaaagagtgctgcccaggactgcgcgatgttggcatgaagaggttggacagggattgttgcaaacctctgcttcaggctctacatttttgaaggggcagcattagcacatgtaaaaaacgcaaaaaaaaaaaaaaaaaaaagtaattgcagtgtgcacactaaacttacagccgcgaccatgtctctgttggtagtatacgcggagtccttcggtgcctgctctagccatttctgaagtgggttgcaagatactgccttagtaaagtacaactccaagaccaagactagatgcaaaagcagcaaatctggtccttacggcggggtataacgtttcaacgatgagtttgatgcggaggtcagggtccttcataaggatcacgcgtgccagaaaactgacagtaaccaacatgggagggcttctacccgcattcgttgaggtcaacaccagcgatgagaaacgcttagcgtccgccagaaccagttcgagtgatatcatgcctcccatggacacaccagcaacatgaacgtccgaggtccatcccagtgcgtccagcagctccaaggtgtcctgggccatctgagaagtggagtagagacccttgggagcgtcagagtaacccacaccgcggttgtcaaagagcacggttgtgaattcgggattcttggcgaattgttcgacctagcatgagcaagccgattagcaaattggacagcattgtagaccgacagcttggcgtatgacaggggagcagacaacgcgcttgcagcataccactggcgcccagcctgcgcccggtgaattcaggcccatgatcagcaagagcttgcgaggcccatttccagtgcgctgataaaaaagttggaagggtttgccgcgcgaagcgcccacctcgacgtggcccttgtcgtcaagcaatgcagatgtcatggtaagcgagtgaggaggaaacaatgcaggctacaattttcgtctgccgctcagacatttgagccgaggccaagcatccaatagcaggcgtggacgctggggtttgatcggcgcccaatttctaatttcttcatacgcacgcttgacaacaaagcttggcatatgcggctttatattttgtgggcgcaaataacactccaaccgatgacctcgggtcatggagaagagcgtggtgttggcagggaccgacctaatgagctgactgaggaatcgctgtcctcgcttgtcctagatcggttccatatcctcgtcctcgagggtggcacggcgagtgacggggttgcatcttgtcctctagagacatccttgctggacgtgcttgtgcttgagctggcccttgaagccgagcgcttgtcggctatcccggatatgagcgtcgactgactcgattctgcccctccattgactggcagtgctcccggacgaggcatggctggtgctactgaatgggtggatgctgcagtggctcttctaattcccgaggccctgcctcctccatagcgtgacctcagctcagctgcctgagccaatgcatccgctagcaatttttggtaaatctgtccgttgtacacctcatggatcccatctcctggtgtgttgtcatacggtactattaacagtgtagaagatcagatgttatttctcagaatgctgtcagacgtcactggcaacgaacttgcagtgcttgccacagacatcagacggacttacaaaaccagagccaccaggaaggacccatgatgctcttccagttggccatgcaagaacctctatcccaaaggtgtgatccacgctccaacatgacaacgttgaagcgaggtccagacattgcgtagttggggagagtcgatgatgatgctgggacggaggtgtagtcaaccctgataaacgtgttcctgacatcctgcaaagactcaatggtggttcgattcttcacaatgtaaaaagtatgtgccgccgtgaacgagacgatcagaaatgccagtattgtagagatggcagtgataatgacccactggatatcgaaaacgcagcgaggttgttgctgggaggagttcggggtccagatccacggtcccgccatatcgcaccgccggatcgccgtgaaaagcaagggcaccatggtggtgacgcaccagatcgccagcaaggagccatagaggatgaaaaggtagaagaacttgtggttgccataaccgatacaaccattaacccatgggcagtggtgatccatcctcaggacacaggtgtcacattctgaacaatggtggcagcgatcaggtttgacgattttgcaaagatcacaccatctagcgcttccgtcctttttcgaaatgctcagtgttgcctcaggcggccgttccgagccctgatcctctccgatctcaatcctgacggtgacgttcatagggtcatcatgaatggtgtttgcgtgtcccatgttgctggacgacggcatatcgcctgcacttgatgccgccttttgtccatgatcctggttcgtggtcgaggaaatcggatttacggcgcgtgaggtcgcctggtatgactgcgcggagggcgtctcaacaactcccgaatgttggttgttccgcaagagaggtgtggtatcagaagcttttgatcgtgcaggatgctcgttgatgcagcttcttgctccttgcgaataggattttggacccctctgaggtcgatatggcgttgttgtgggcgggataggtggtggtgggattctatgagggggctgtgcaagaaacaaagggaaaaagcttcctgattagcagcgcaatcatacttggggccatacgcgtttaggggtagcttacggaccttcaaaggcgatcctggcttccggaagatggtgcgtgcatacgagacgaagaaaagtacggtaaggacattaaagacgcccaggtagatatctagggcaagaggacgagaatcgatgcaacagatgcagcagatgcagaaaggcagagagtcgacaggcgaggaacaaggcagtgttaattgcagactccctaatcgagcctcttggatccccttttcgcacccctccccccttttttttcaacttacatgcttgcgtgggacggtgtagttcatgaagaatataatcgactgcagagccagtgaggtgccaaggttgaaagaaagaaagggacggatcctgggtgagtgagcaaaagagtggacccaaagagacgaccggtgtggtctcgtggggatcagggtgcatgcaagcaactcgtattgccacctactgcagacgcggaacgtgtacacgtagtaaatatagactattagcgccgacaaggccacaggcagcagccgcgagacagagtccggaagtccgacagatcctgctgagcgcgaggcagccccatccgtgctggcgtgatcatgggcagccaatgcagccgcatgctgggctgcagtcatcgctgtgaggttctgtgatgcagacgagggtgctgctagcgcagaggaatggatcctgtacccatctatggtcatgggcactggcatgggtgctgtggactctgttgcgtgggctgcagactgtgcacccccggttgtgcctgagaccaccacggccgctggagctgtggtggtggtgatgcccgtcgtggcgggctgccgatcctgttgcatgctggtcattacgatgcaagaaagacggtcgaatgagcgactggcgccagggaagcgggtggaaggcggaaggcacggcgaggtgaggtgacgggaagcggcactagaaaggcggaggtgaagggtggaaggtagaggtgaagggtggaaggtggaggtgaagggtggaaggtggaaggtggaggtggaggtgaaggtggaaggcggaagaggggaagaggggaagagtgaagggaaggcgatgcgaataaagatggcagcaaaacactgctgtacacagacagacagctacacgattacacgatgacacggcagttgacaagaggcgtgctggaggctgggcacaggacaggcacagggaagggcatggccatgtgtccgggcatgcagaggtgggggtggaggaatcaatgcagcaaaaagacaacgacgaggacaagaggcaagagacacataaaaaagagccagattttttttttgggtcatatgcaagtcccgttcagcctccatgcagcgtcgagataaacacaatctcatcccgatcctccagctcgtactctagctcgccctcaagttcccagtcagccccgttcaccagaaccaggataccagatcgtctacacgttggagatgcaaacaggcgacgttaggatccacacaccgtcctctcctttcgcatgcgcctgagagtcaaaattgcaatgcggacacttacactgatccgtcagccccgatgaacaactctggtcgctccttcaacaaagtgcttgcgatccagccgatcaaatctcgaatcgtcgttgcatgccgttcttccgtgctctctgtaggaaacgacactggtaccttggcatggacggtcttttgattgtcaaagagcagctccatgcccccgctattcatgattcaacggacgacgccttgccattagtcgagtctgaaccgatcaggagggagagcagcgtggcagcaaaaaagctctgtacctgaactgcaattcgatccgtaggctgtccttggcatccatggtctggtgttgttcctcctgctgtgaataaagacgcgggtcgtcaaagacgttgtgggctgtggcggtgtgggtgacaaaaggggcagaagaacaaggtcaagcgggtattttgatttttaactctgcactttagctctaaggctcttggtgtgtcgtcttcagaaagacaaagctgacagggctttgtccagagggacaactcgcatccgcctcgtccgcctcctcactctcctcccagttgtaatcgaatccatcctcgcagccactaatggtcctccataggatgcggtcctgtacagccaacacagatatcaacgacgcatcatcgccttcctgctctccagaccgcgaccgggccttgcgccatgcctccacatcgatgtggtcccactcctgcagctccttcttggccagtgaagccgatgtcttgtccatgatcgcagcgtccttacccttctccagtgggcacttggactccaaagcaaggcctacgttgatttcaaggggcaaagtcgtcgagttgcactcgcaacccaggagagaatgcgtgagacagcgctcgtcttcgtgaaacgtgaagagatcccgaagctcagccatagaaaatttgtttagcttctctgcgctcttgccatcctgtgcagtcagataaagtagcacagagacgtcagagaacattactaaaagacaatcgttttccatgtctctatgcttgtgagatcgtgacagtctattccataccataagtgcatcgctgagtccgactttggtcagctgcctttggtacatcttttcttcgattgtccctgctctgtattgtcaaagagtcgtatacaacattggcggtcaaaaaactatccacgacaagtataaaggtgaactcatgtactgtcaacgcatagaaacttacgaaagcagtcgataaatgtagacgggtctgggctgtccctcgcgatggatgcgggccatcgcttgctggtcaacacttggattcctatggtcagtacgtatgcctgctttagtaaaaagaagaacccctggtggtgatactgaggacgcgacctgtatttatgcctcttaccagtcaatgtcaaacatgacctggtcgatattgagtcaagagcacctattagtctcatgcgttttttaacaatctctcaccgcacaaagcacaaagcacagagcatcgagtgagcaaccactcaccagtcgagatgcaccgatcaggttcaatccgactcctccagatttggcactcaataagaacacgactagcagtggacaaaatgagtgaatcagggcatgatgacaaaacgcctcgtctaataccgtgtggctataactgagttacatttttggcatgatggtgcattgaacttgtccacatattcctggcgcttgctcgtcggtgttgatctacagtggtgagagagcatgcgtattcatcagttgccgagcataatagagcctactgcatgcagtcatattccacattgcatatccatggtgctgcctcattacccatcgagtcggaaaaatccatagagattctgagtgcatatgttttccagaatatccagggtctgtgtgaaatttgataccaagaccacacgttcggacgtgctttccttcagtgttcgaaggagggacaccacaaagctcagctttcctaatggtcggcgaataatgtactgttaaagagcagcacgctactgaaaagtctagcacacaatcaagagtcaacaatagcagaggttcgtaccaccggtcagcgagctgcccatgtcgcatccgctgttctcgatgaccgatttgacgccttgataaagcccgttggtctcctgactctcattcagctattaggcaaagtgacaaaatcaaaaatcgtaaggcagctgctcaaaccccactgtgtgaagtacctgacgctgcagtagatccatgatgcaaacatacctcagcatgatcaagagttagacttggagaattgcacaatttccttagcgccgtgatgcaggtaagatggcgactgctgtccattgagaagcaactctgcagatagggggattccaagaggtggcgatagaccgcgctttggacggacgatggtcggcaaaagactacaagttcggctatgaggaaaattcaaatgcaaataaggcatgataggttcgtaagtcctttagtgttggagctgtaatgtcaagtcgatgcgcttagtccttgataacattacatttcgggtgcaagaactcgtagttcacttgagccgaacggcgaagaatgaattgccctgtcaatctcgagagctattgggaagtaagtaaaattgttaaaaaacagactatgatgctgcgctcagacttgcgatgcctatgaatgttgacctccgatagatacattacctcttgagatctagagcgcaaatccacaatgtgcctaatgttagtcagtgttgcgctgctgtctgcttttcagttctcatgacaaagtacgacatccatacctctctaagccgagggcggcctccgaagccgaacagtcgggttgccgtgagcgcacaatgggatcctcaaacactcgtttgaaagcgctgtaattttcaagcaggcctgggttcacaaagtcgatcatagcaaaaaactcgccgagatcattttggattggggttccactcaatatcactctccgctttgtcggtagggttcgaatcgcttgggcagtcttgatgttggccgttttcagtctgtggagatcgaacagaaaccatggtaaacacatatccagctctcttcgtgcactcttcgtgcaacacttctggtaaacacgcgtccgcacttaccggtgtccttcatcgcaaattatgatgtcaaagttcgcgttcttcaactcttcttgaaccgttcgcagctagcaatggagatgcgcacgatacaaagcagatgtaggatgtggcatgagaacatgaatagcaacgtcctgaaaagtgacttttcaaggatgtacggtttaccttctcatatcctatgatcattactgggtagactttgccaagggtgaaatccgttatggtagactttgagtcaacagcaaacacgcgcagacgctcattcccgagccatttcttgaactccttttgccagttctaaaatcaaaggaatgaggcgttagaaatgagcatatgtacatagtctttgtgcggatgatccactttctgtattaccatgattaaagatgctgggcagaccaccaatgccctcctgactacagcagtctcttcgccatggtacggactttgcttcagaagtgtccacaaaagcgcaatagtctgaagcgtcttgcccaaccccatctcgtcagccaggattgcgccttggccatttatatccttcatttgcatcacgcactcgtacaggaagcggactccttctttctggtggggtcgcaggtgctgtcctagaacagggtccaccactacgtcgaccagcccaatgtctcctgggggccttttggtgctacagccccttactacccttggatgtgtactcgatggacgaggtagcaggatagcgtgaggtgtatccggattatggcgaggttgcggtggtgcataaggaagctcaggtgcgttggccatcgcggcatgccctttgaatttggtccgtggtgcgctgactaagtataagttgcaaacctagtttaaaaagctgaacgaatgacgcgacaacatcgagtgcgagcgatgcacaagctccattgttacctgaggtggtgacagggcctgccagcgcgacgtttcgcatgaagcatcttcctgcgcggtaggaagctacgtccagcgtcgatgttacctgagcagagaagtggagcttgttaaggtcaagcgacacagctgctgctgcttctgacgtgtgtcaccgtgtgcaaccctcttgcctacctcgatatccttcccaccgaacgaaagttcatcgcccgcatcaagctcacgagtgatgttggtgcctctcccgatgctatgggttgagaagctctgtcagtcgcatcaatacactttcggaccttgcaaacatctgttggcgacgctcttctggtgcacacatactctttcccgtccatgtcctttaatattccgatggatccgttaattacaagaatacctaaaggcaatgcagcaaactgattaactacccagcacagcacgacatccaagttacccattccacttaccatcgccatcccatgttttgtgtttcttgttcgtttttttcctcctagcagtggcgagatggccggtcagcgacggaagaaggttcagagccaaaggacaggttcagtgcgcgttatttaccagagaacgtttaggcatttttcttcagtatccggactgctcgtgggtattgtggttgtagagagtgctttgaacgaggtagtaggatggagcgttggggcgtttgctgcacgataggttggcctgggacttgctgctatcgctggttggactgaagacggtactgaaaattttgcttgcttcttggacaataggcttgttgactccagctggcgcttgtttgatatgtctgggcgattggaaaccgccagtgggcccgatgcctgcgtcgtgggcgaagctctcgaagttgactctgagacctgatctatctttgctggcgatcctgagggtataaagtcttcagcgcctgccagcacgggcgacttgaatggtgtcttgaagggggatttgaaaggccgtttatggaattgcggtttggagagtgatgcaggccgttgctggacagttggcatgttgccgctcgtggctggacactttgcctccaaagttgcatcaggtactggagtgttgccggcatcgattgctgcattctcgtccttcggagccgagacgttggctcgctgacggacttgtgatggcgcagctgacctctgcatgagatctagagcgccagaggatggcgaacgggaaagagggtgtcaagagctaaaaggaagacgagtgaatgggcaatgagaaaagtgttgcgaggctaaaagccctacaagccaaagttgcccactgcgtatgtgaaaaacacatctgcaataacacactgtttctctgtttccacgacgttattcaatagcgcttcaggccctcgctctccgtttctttctagccctcctcgttgctgagttacatccctgtaaagatcgcctcatttcacgccatctcagcaatgagcaagcgcatcgacccctcactctccttagaagccccgggttacttagtggaagtgtgagcgtttttctcatagcaccgtcgtctcatgggtccattgctaattttcatttcgcattaccctctaaatctagctttttttctagcaaacaacgaaaacgcatctccaggcctagttcgcaaacactacttttcccggaaaaagatcagagtgagaaaacgagaaggctgtgtttgcctgtcatgttggttgaggccatagagtctatagattcctctctttgcgcaataaaaagtttgctgtctcagtcgttgactatcacaaatccatcagtgaaatcatagcgctgtcaatatgaagcaatgggccgttaggtaacggtgaccgaccgctgctataaatgtcgtctttgaccgaggatgcgtctcttcttcacctttgccttctttcgaagtggatcagtctcaggtaagagcctaggcagtcaaagacgcaaagcacctcgccctgtttcccactctcctgcactccattgagttccttgcttccgcgttttgatcacattctttctaattcttacaacactgcaagaaatgagctgtcctatgttccggtaagtgaactgcacaagtgccctcactagagcatgccctgaactcagagcaggcgtctaatcgtagcttcttgtcgtttcaagtcgtgcaaggtctggagtttggtctttctccacaccaaaaaagaccaccccaatgtgccccctctcctttgcgtcttttttttttattgcttgcctgagcatgtaagtcatccacgtcttttggtcttcatgtcgagctgcctacttttgaatgctttctaatatttctctttgttcacttctccttgaagcatcaagtttgctacgagggacaaggacgttgggttcgcaaacaccgccagatactcacaactggatcaagcccacgcttcccccgtccacgtggactccgggggagctcccctactgagggtgcatatagtaagttctgtaaaaaaaaatgttttttgaacagggatacacgaacacattctaacatttcaagttttcactatccctggtaggcctgtaaaaatttgtgacgttttattcaatacacatcgtcgtggttttgtacggattctgatcacgtattgcgggtggtgagagcgaggtgtgcctcaataaccttggcctccagctgggcaatacgcgcattttgctcggcctccttgacaaggaaccccgtccgctctgtctctaagacagcgactcgcatgttcaggcgcgtgttggtagcctccagatccgacaccttgacctccaaactctcgagcttgactgtcttcttgagacgcgaacgacgcgcagcatctgtgttcttagcgcgcttggcgaggatctcctccgactcattctcagcaggagtgagagcgcgcttgtgacctgcgcgcgtgggggtcgagacagatgatggaaccttttcaccgtgcagcgatcccgtggtcgcgagctttctgctctgtgctaaaacagccttttccagctcatggctccagggaatgttcagtgcagcagcagcgcgctggagggtgcttgtggtcagaccaggcgatggagcctgctctacaggtcccaaacccaagtcctgggcagtaagacccatggaatatgacaagggaaggttaggctgcgagacctcgaagagcgatggcgtcgacgtcgacgagtacaagacctcttgcgaaaggagaggggagttgtctgattcggaataagggctgggcgctatcgtggcttcgtcgccacttagcagcgttccaaagtgaaagtcgccagcgagccattcatcaaatcctccgcctcggctcgacatctcagcgccggcattgggtcgttcgatagaggccgcaagtttgccgactgtaacgttgcaaaagaatgatagaggcaggatattgttaaactccatgcctttcatcaacgtcaacgtctcgtttctgatatttgaaaaaacttacattgcgctagagccgactcgagcgagtcagccgactcagtcaagcgcgagttgccgacctccagtaagaagggtgtgttgggaagggccattgtagtagtggattgtagagagcgttcaaataacagattccagagtggtgtgtacgatgggtgttctgagtaagggatgcctaatacttgttcttgtggttcttctagtggttctgtaagttctgagggttgttctggaagtagtggtggttgaagagagataggatctagtcattttggatagagtgctttgctcgaggcaaggtgttgtggaaagggatgggcaagtgggggacagaggagacagattgattcaggcgtgctgatttttagcgtctatatgcttgttttttttttcagagaatgtcttcggtgcagaaaagggcttttaagcgaggagggccatggcgggaatcaagaaaacgtaggttgagagaaaggtttggcgatagaaaggtggataatacgtccgaatataaaggcaaggatggtaaaaattatagatgtttggttggcgttgaggtttttgaaggacgaaggaggaatgaggagagaaatcggttcttttataaagcgaatatgcgcttctgcacagagcactcttgagggtccatctgcagtctgtgtaaccttctcaaagcacacgatgcaaagtgactcaccgcttgagtatttttttaccctgcttctagcaaaagataacatcgaccgtcgattcatgatgactgcagcgcccaagggaggtgcagccggctataaagcgaaagacaaggacaacaaaaagatgagtaccgccgcatggggcaaggccttcataagtgatatgtgcaccatggcgcacgggccacagatgctctacgacgcaaaaagaggcaaatgccaaaagtgtttgtactcggacttgaaccgaggaccgtctgtgtgttagacagacgtgataaccaactacaccatacaaacgtcgcctgatcagaaaggctgatcattggctggaatgtcaacccctccaggaatttaagtacctcaagtcacatgctcagcgctaagtcacatgtcatatctatatcacgtgcctctgatcacagcctcaaggtcaagcaagacccagatgttttctacgactttcgattttcgactttctaggtccttcaccatggaccatatgaccagatcacaagaacgtctttacgatatccaaatagcttaacattccatacgcttctatagcatagccaaagcagatagcttaagtagcgaggcaccacctcaataaacatcacctttgaattggtcaagtttagttttgagtcttttgtctgttcagttcgttcaagtcgttttcctacccagttactattgaccccctccctatcactgttcgacgcccagtagcccgtgacaggaaacattgacggattaaaccgatataaaccaaccaacaattgaaactcctgtagagaatggctcagttatcgcctaatgacgtcaccaagtcacttctgcacggaggagtgtgcttgcaacacacatattgcgggggaggggcactacttgctccgcttcttgcggccactttcttggaggagcccacctcgcttggaaccgctctgtgcttgaccagccttcttgctggcatcagacgccccggctccagctccagctccagctccaggttctcctccagctccggctcccgccccaacggctgtattcagctttgaatgggccatccaaggatagtgaccattgtcgtcgacaggctggagataaagcggtctcctccactccttcaaatgcccgtggatcacgttactcagattatgggcggccaagacatccctgtggatgtaggatttgcaacacgggcaatatagcctgcggatctcgacttgggcgacaaagttctggcaccgagggcatttcttgctgctgtaatattcatttaccccggtcactatataaccaagggctctcgcctattgtagaagtcaagcataatcagtaaacgtgcaaagatgccgccagtgaaagacaaaaacgctccttgggcttactttctgcacgaagaaagactgaaaagacgtatgcaacgacgtgagtctcccttggctggcgaattgtccgaggccaatcccaatgatcaccttgttggcagggtctcgctgttgcccgactgagcccccaaccattccaaggagctgatcagctatgcggctgaactcctcctgccgcgcgcggcgcatgtcccatcggtgtttcttgtatctgttgcggccgttgtagaatgtgtccagctgaagcttgactgtctgcacacgatcaatgtacttgctgatggaggcatcttctcctcgcagcgggggcagctcgctctcgatgttactgatcgattgttcaccgttcccaggatcttggctcttttgctgctcaacccaccgtctgtgtttgaatgtcggttgtgacacggccttttgcttaacggcgaggttattaaacacgatggggttctccttggccttgctgtcatgtgcttccgggattcttgcgaacgcgcctacgacacaggcctgaccaaggtcgagggcaaggattttgatctcctcggctgggcagccccataaaatctgcgatgtcctgttcattccgtacgatgttgcgcacctcgctgagatgataatcgaccccaccaacggtcgacgtgagccgcgggggcaacatctcttgtggaaaacgcctgaacctgacagattggagctcttttactttgtaggccaagagttgtaatcgatggccgtccgttcggattgttcccctcagcacatatcgacatttcttgatcacttccccatcctctcgcaccactgacccatcgtattctgctgggttgaatcccgctcgtcgtaggttctggatgtgaactgcgatttcttcctggtccatgacggtggtcgtgtccttgaagctacggcgtccgtggcgtggctcgtccttgccgacatttgataacagtcttgtaacaaggtcacctggcgccgccctttggagcaacctattcaaatcatgctgagccggcagaaaggacgcagtttcgagatcctccaacacccaagcccgaagctgttccttcaatgccgagttcgtccaaaacaatatcccaagttccttctcagaaaaagagacaaacggttgctcaaagctggtcagcggtacgatccggcgggaacacttgtcggcccggttcaagatgacaaagttctcaatggctgtaatctcgttgttgatcacggtaggcaatcccggagcaagaagccccttcgtcttttttttctcaagctatgaaaatatgaccgtgaaggtcagcattgcagttttctctgtatccacatgcaacaaaagatcggaagacgtagcttaccttgagcgcaagttcggtgctgccctggcaatattgcctttttatctcggtggacatctcttttgagacactgcgaagaagactcgagccaggatatggcatagtgctgttcgtggcgcctgggtcgtttgtctccaataagccgagctccaccgcccgatcgatgaattgcttggcacgccaggcagctgatttgctgggtggctggccggggttggatgtcggtaccacaacaggattgccgctgtaagaccaagatccaaggagcccttgccatccactccacccgatcactatcggtcttggggcgaggcacagtggtgaacgcgctagtacttgcacgaatgtgacacattatatgggttgtcgcccccacacggccagttcatcaagcagctacacaagattatccgtgatttcatgtgccctttcaagccccagccaggatgggcagtgatcacgacacacacttggatctgccacttaaagaagcttccagaggtcccaaacacgcttgtgcacctccacgcacagaaccacggcacgctcgcactcaaccactgcttgagtaagtaaaaagtggctgctgtatggatggggtcgtcatagtggcttgcccgtctatgggtctatggaattttacaaataaaagtacatgcacttacagcgcctctacactgcaaaaccatagcggctcggtcctcctcggacagtgtgcgtgctcgacgtgtccgacagaatcgccacactgctgcggcggctcgcgtcctcgtcgccagagacctcagagtgtgtgttggccgtgtgaaacgacgcgctcgtcgtcatgctcgtgtccactgtgcccaccgtcgtgaaggaagacatccggtccagtcgcatccctccagagtacgcctcgtcgccgctgctatcctgctcgctctcggtctcacagtcctcgtcctcgtcctcatcgtcactcgacacctcgatggcctgctccaacagaggtgggaccccagccgtagggtcaacagagaacgatccaagtcggctacgcccgccttccctaaacttctcctttcgctgctctttttgagccctgctccgttcgcgtcgatcctgcctcttttggatcgcttggctcctactggcccggctggcctccgcagccacgctcaccaacttcaaacctcctccgccaccgccacgacatccaaggacgccctcactgtcgctcaggaccagctcgcctcgatgctttgtccgctgccgaggatggcgtgaatgggatcccttgcgagaccgcgtgccatccagcttcagattaaccagctgaagatcctcaacaccgttcaaagcgcccgacatgcctgtcccatcgctctcacgaccgtccgtcatctcgtccccttgcgatttgtgctcttcctcctcttcctcatcctcctcatcatcgtcgtcttcgtcatccacgagcacgccctcgttcttgcgccagttctcgtgagcaggcatcggctcctgtgatgactgagcggtttcctgcccgtggctaccctgaagtccaccaagaatggccatgcttcgcttctgaaggatctcgcgcttctttttctgtagcagctttcgttcctgaagcatcttttgctctttctctgcactcgcgcgttcgtccagccagtgctccagaatcgtgcacagctcctccttcttgatgggcttggacaggtacgcgttcatgccactggcaatgcacttttcacggtctccaggcatcacacacgccgtcatcgcgacaatgaacggatccgagggcgtgacgccggcaatcgcttcacgaatctccttggtcgcctccagtccatccttgaccggcatccaaacatcaatgaaaataatatcgtactgtttcgccgccacagaaggtgcctctgtacttccttgctcctgtgcttgcgcagcagcagctcgggctcgacacatgtccaccgcttcctgaccattgttggcaagctcgggtgtgataccgatacgacccagcatcctcgaaatgaccttttggttcacagggttatcgtcaaccagcagacagtggagagactcgagctgacgtttgcgctcgtgctcccgatgatccagatcaggcggcgcagtgggcgccagcggccatgagcctgtcatcaagccatgcagcatactgaacagcttggcctgcttgacaggtttgaccaagtgcccaacagacgcatccgcgaccgatcccggtaaaaagcctggtccagtcaaagccggcgaggggcacttgtctgcaaaagtgtgtcccttctccccagaggtgctccagggtgtcaccgcaagcatgccgctgttgataatgttgagggtgcaggccgcctttccataggggcgagcgaccgtggagtcgggctggctgtcacccggggactttgcactgccattgggcttgtcggaaaggctctcatggctgctgctaccgaccatgcccgttccagaaagagtgtccagtgggtttgtggatgttgtgctgccggcagtctgtccctgaggcatatccgcactgataccgttctttccttggctgggcgagggcgcgacctgcagcaccaaggggggttgttgacgacgatgataggacaccaacacacacggaatgggcttttcctgtctctgcctggcctcctcgctgcctgcgtcgtcgtaggggatatttcgcacctgctgtagaactgccaaccctgggttgatcttggcctgaggcttgtcgacatcgaccatgatcacgtccacttggtttggattctgtcgcaggtagtcgagtcccttgggcacactcaagaccagggtcttcttgaagccccaggtggaagactgatactgccacgaggtcctgctgatgcgacgatcgtccaggattaaaagggtcttttcgttaaaaaaggccagatttagctgcatggcgaccgttggactggatttgggagactctagcagcgtggtgaaataaaaggtcgatcccaccccttgctcagactcggcccactgtgaaaatcagaatgaatagaacggcgttaagatcatcatgtcacagagaggacagggttcgttttctcgcttcaagagctaccgcagtgttttcaacgcttaccatttcaccatccatcagctccaccagcttcttggagatggccaatccaagacctgtgccgccaaagttcctggtgacagagtcatccgcctgcgaaaagctcttgaagaggcgatccatccgttcagcgggaatgccgcaaccttgatcgaccacagaccagagcaggtccacatggttctcaaggcgctgtgcccgctcctgttcatcctcaaggttctgatcctggaaggggttgcgtccagtagcactcaaggactggcggtaccggtggcccaacctagaggagacacgggactgagccacatccagactcgaattggaggagccctcgtccatatgcagcatcagctgcgacgactcttgtgctgcttcctcagcgtcatcgtcctcatagacccttgaggcagcaagggagagcctcggcttgggctcgagcttgacgacaatattacccttgtcagtgaacttgatcgcattgctcagcaagttgagtagaatctgtcggatcctgaccagatctcccagcacctgcatgggtgtgttggggtgcacgacgaatgtaagacctaggcccttggtaccggcttggatagagaccaggttgcacacagactccagcaaccagggcagatccaggggctcaggagacagcttcagcttgccagactcgatcttgctaaagtccaaaatatcatcaatgaccgccatgagctggttgccactcgattcgatagtttcagcgcagtccatcaggtcgggcgagaggtccgactccagcaaaatccgcgacatgccaataacggcgttcatgggggttctatgaatcgcggaaggtcaaaaatagcgcgttagcacacagttttttaagaacatcactctttttttgttccttctcaaaagaagggacaggcagacaagggaccgagcgttacctgatctcatgagacatattggccaaaaaattggactttgctcgagcggcatcctcggcgtggttcttggcctggtttagatcgacaagaagggcctccgtgcgcaatcgttcctcttccagctcggctgttcgggtctgaagatgcatcgtcctggtcctgacgagctcctccatatcgttcgcgtacttttccaacagcgcggccatgcccccaatcatgtctccatcaggacttatgagccgcagtcgatgcaaaatggaggcaaaagacgggcgcagacctggatctggttgaaggcagttgcggatcaaatggttgacggcgccaatgctctcatccgaggcatcgtccagtaggaaatcgggtcgcaagttctggtacttgatcatgcccaacaaaatggacggaccctcgatgggatcaagagcgagcagttgcctggagtagggtgttttccgtgtcatgatctcgttaaagatgataccggcgctgtatacgtctcctgtcttgctggccagcttgtggtagacgtctccacgatgaatcatgttctcgggtgcgacccagagtccgtccttgatatccttggcttcgcttgcaacagggtacgtctcctccatctccaggtgctcgccacctgaaaggttctgaagcggaacagagctgacagtcccgttcgtgtattgactgtcgctactgacccgcagcgagtttctctgtcccccgtgggcctcccctgagccagcactcccatgagaattccgtccgtaactgggcaactgggtctcgaggagttgcttcagcccgtagcttccaatcttgacctcccagcggctggtgatcaggcaatttgcagaccgtaggtctccgtgaaactggatttttgactggtgcaggaactccattccccgcgaaatgtcgctcataaatgacagcttgaagagccagttgaagttgaggtccgggttcgccaggacctcggtcagcgtgcccttggagcagtgctccgtcacaatgcagatatcgggcggctggaggcagaccccgacgagttcaaccagcttgggatgtctcagctccatcacatccatgatttcgatcctcagctgacgcgtgatgttgactttggatcccccaatgcgacggacaaatacgggcagattgcggtagacaccaatggcctttccagagtcatccatgggttgtatgcctgagggaccgcccacaaacgtggaatggctccgttgaaacatgcctgtgggccgcaagttgctgtgcttactggcgtgtttggcaacgtggagttgttgctccaccatcgagcccgagtcctgagttccaaggccactgtctgtatcgtgatagacacccatgatcctcttgtagtccagcatccaagagtcgtccgcaagtcgcgtgcgccgtttacgcttacggagaaggcatacgcccagagatccaccagcagcagccaaaagtaccaggcccaaggacagaaagataacaagtgtggtactgtccttgctcttcttgttcgtcaagtaatcctgacagtccgcgacggtttcgccagagtcttcacaacgcagacaggcgctggatcctgtctgattagcatacgttcctatagggcaggctgtgcagttccgactgttgacctcgtcgctaaaggtcctgagggggcaaggctgacagggaggcagcgcagcatgcaggctagagttgaggcggcagtaaagcgaggacgagagagcaggattgagcatctcgcctttgttgcagacatggagtacgggagacgggcccgtggcgataaagttccagctcttgtcctgtatcacggtgctgagggcaagctcaaagaccgccataaagccgttcaggtacgactgctgggaccacaccctcttgaccttgcccgcgacaacgtcctcaaacacggccgacgaccgtcctgtggttgtcagcatcacgcctgccttgacgagatccttgacgctgtccttgatgttgtcgtagagcatggtcgatgtggtgtggatactgtcgaatgggtagacactacggatagccgaaatgtttttggatacgcccgcgagatcccccggcgacagctgcatcataaagatgctaatgtcggggagatcgtttgggatcttgaggctcactatcctctcgtacataccccggcacattcgcgcttgctgttcgggcagaccgctctctacgacgcacagaggacggctcagtccgttccgcagaatagtatctgcgtactcccatccggcttgaattccatcctcgcccacccatgaaaggctacgctggctcgacccgccgttgttgggggacccgattccaacaatgggcaggggcaagacggtcctcgaagtataattccaaggcactgggttggtgcatgtaaaaacctgggcgggcgtgacagggggggtcagacccgtgtcgtcgcatcgttgacgctcttccacgttgatcgattttgtccggttggcgacttggagaatggttcggttgtaggcatagtcgatgtaggagggtcgcgcattgctcacgataagtccctgtgtatcggcgtcgttcagagcaagatcaatgctcttcagaacaatgtcctcccgaacggggctgtcgtaccgatactcgtgcatctcccagttgagcatgaatgcggcattgcgtgctcctattgctatcgcgtcccaatgatcgttggatgacgcactattaaaagtggaatagtatacagaaaatgactctaggttagatggttgcgttcatgggcggccatgaaaagaattgtagtgcattagcatcaccaagcacttgcctgcctgtgaccataaaaaaacgcttctgccctttctttttgaattctcctacggtccagcgctcctgcgccagcatctctgaggcgttcgagggtgttactagctttgatccagtgatgatctcttgctggctgatccgctcgtgcatcgtcagctagtgtcaaagtggggagcaggcagtttaagttaagagaggatttgataaagtctcatttttggagtttgcaggcggttcgaaaggttgcgacggtgtgagattctttacctgaacatagagcagtaggatggggagtagcgtttggaggtatatgaggttggagacggaatagtgaagcttgtcgcgatccatgcttgtcttttgagccttgttgaagtcaaacgttgcaattttgaatgagcgcgacttgttgagagcgacttccaggctcagggcaacgttttggaagaggacggaggagaggtagacgatccccgtcacagagtccttgtcgacaatggcctttgcgatagccgggaggtttagagtctctgtgctgttggcactgggcttcactctctccactatgtgcatgtggtcttccactttgggcgatgcatccgttcctgcacccgtgaatgccgacaggacgcctttgcaccggtcgaccaaggagctcagcttatcactgctgttgatgcagacaaagtccttgacacctacgttgaagcaagaaaagacgtgagtggcccgtgcagtgaggtgagaggaaatgggcgtagttttgtgacaagggcctaccgtccttcacgagctgcttgccgatgagctcgccggccttgaactatcacgatacacgatacaccacagattatgttagtgagacatccaggctctctcatttcactctatcatcttccgacaccgggtacttacatcgtcagacataacagcaagaatgcccagggccttggcagcctgcagacccgtgtagacggcgatgactgggatgttggcatccaaggcggcctgtatgggccccgataggacatccgcatcagggatagagacgatgaggccgtcgactttggccttgactgcagcgtagatagtggcactcatctggccactgtcgtacgatcccgtgtctgccgtgtcatcgtttacaataagggtcgaggtaatccgattatcgagctttgtaaagtcggtgacgatggccgattctacagtgacaagtcgagagtgtgagaagacataccaggtggacatgcagctgggaaagacatagactctgagtcaagttggatcatttatgaactctggcgagtcgcttcttactgtgagtaacaatggtgatgcgttgctgcttggtctgatcggcgcagaggggcttttcatcagagtagttctggtacgtggagatgccccagaaggggtcatacggggggttgggggagccaggtgggccgaccgagggggtggggatgacgacctcggtggaggtggcgatgatgatgggctgcagaggtgaggcaggcgctgtctgtgcgtgggcgaggaaggtcgagtcgagggtggagagcaggagcgcgacgaggacgaatagggcgaggtgtggcgaggagaagtggacgcgatgattcgcgcgacgatacacgctagacgcgaccgtgcgagcgggtggtgtggacgggtgagcgcgtgctggtggatgggagggccaagcctgcgttgagcataaagcagagtcggctggcgggtgctgtggcgtgctgttgttgttatggtcgaggggggtcgatggaggcggacgtgagggggcgtgacagaccgatgtggttgcggacgccagcgccaacgccaacgcagcgtgggtgacgggcgtgtgtgtgtgctgggacggaggaggcgcacgagcccgtttgggccggcgcggacggggcaaggaaggggatgccatggcgacgcatgtgcccctcacggccacaggacagcgcaagggtcgggatggcgaagagcgaattgcagctggagggcgggctttgaccaggcgtggaatgtggaggagagagagtcgaggcaggtcaaggcgaggcgaggagtgtggagacggaggagaaggagagaagagaaaggaacagacaaggacgagggagcaggagcttgtatgctgacagctatgctgcacgtggctggctatgctgtatgctgcaggctggctatgctgtatgcgctgctgaagctatgctgctgcagttgcgatcgttggaggagagagaaagagagagcgagagagagcgagaggggtgcaaaggggcaagggctggctgaggaaagggcggggcagtggtgagccgaggattgagagggatggacaggaatcaacacgacgaggcaggatgtcgcgggattcagagagtgcgtgagagtgagaatgagagagtgagagagtgagagagagtgagagagagtgagagagtggaagggtgggagagagagggaatgcgagagtgagagagagtgagagagagtgagagagagtgagagagtggaagggtgggagagagagggaatgcgagagtgagagagggaatgcgagagtgagagaatggcgtgcgaaggagagatcgaacaatcaagatgagagacagcaagaggacagagaaacaaagaaaaggacgtctgaggcagaaaaagaacaaaggattaaaacagaaaacgaaaaagaaagacaagaaagaaagcaaggcaccgatgtcgagtgcaagcaaagcatgcttctctgatatgaagttgtatatgctcacggtaacactctgctgcgtgccatagccatcagcaacagccatcagtaccctcacccacccacccacatggccactcgtccgccacccacccgcatttctaagcgggcaggtgggcgctcggctatttctccctcgtctctcgtctgcaagtttcacctcagagtcacagtcccccattgttatccatgcaaacgcagcctgtcctcggccaaggcgacgccctttgttccctcgtcttggacgagtgtctgtgtgtctctgcaaacaatcgcaaagcatggcctccttgtctctctgtctctcgctctctctctctctctctctctcgccctctctcgcgcacgctctttgtccgagtctatccacacgacgccctgtagagtgatgttctacccaagagacaaaacacacgagagcaggggtcaaggggaagggggattttcaatttttgtatgaaaatgcctattgatagcagtgggttgcgctgtctgtgtgtgagcgatcatataaacaaggttcaggaccagacggcaaacagcgtcatccattttgctatttgctggatgaaaggacctcgcgccaaatatctcaggaacactactgacgaccagaaacatggccgaccaccgtacgcggacgtactgtactggggcgggaagtcaaacggtgcccagcaggtcccgcttcatcaaagcacatccccctgccctccttgtctagtatgtacagaatatacacacgctgctgtatcctctgcggaccgctgggcagtgatgacaaacagaatgcgctgaataaagttttacttctctcagtggtatatacatttattcgcattctagcctatatcctagtgcactcatctgagcactttggcaacccaccgcctcttgtttgctcaagaaagctgctgtggtccactgtgtgtgcaggtaagcgtgtctggtcaacttgctctcagcgatacatgcagtggaataaatgaaaagaattccccaaaaaaaacagtcctgcttgcaacagtgcgctgtgcctagtaatgaccactgtcagttcaatcgatatctgtttattcgccagggcacacccgagccgcgcttaaatgcacaaggtagggggggccatatgggggtatatatgtatatatacaagagggaataacgaccgtcccacgcaaccctcgcgcgcgcgtcgggttcattacaccatctccaccatctcatcccgtggatgtggtccagaatcaaagggtcggaaccagggcttggagatggcagagctggatgacgacgacgacgacgcttcgtcttctgaggacctcgcatcatacagatcgttcttgtcgtgcttgaccttgaaccgcagaccgtctccaagcatgggttgcggccatagccaaagcaaagggtttttgcctagcacctcctgaaaattggctaggatgccctggtggtagggacatttgacctatcgagaaaaaaaaaagtttcaagtgtaaagcgtcagccattgtttgaaacaaatccgtttatcaagggccattcacagacaagagcgggcccttacgtcgcggatcttgcctcgccggatcatggtcagcacgcgatccttctcccagctctcgatggtggtggtgttgctggaaatacaccagatatggtatatggagagaacactgacgccaaagaggacgggaccgtcgagacacaggcatacgatgatcacaatgatttgctccggtgtaggcgcgctttgagagttctatcaggaagaaggaaaaggttggtaagcaacgtctctgaaggtacagcgttccaaaaccatacagtctaccatgctgtctgtacgacttacaacgcccagctgctcattgtcataagcctctaatgaccgtaaaataacgagtgcagcgcatatggacgtggtgatagtcgtccagagtataaagcgcacaaaatggccatagttgaaaaagccgatacagttcctgacccacggacagtgatggtccattttgaggacgcactttttgcacgttcggcagtgatgagtccgcggcggtttgtatgcatcgcaggtacggcagtagcgaggtgtgtgtgtcgttcgcttgtactcaatgcttgaaccgtctatgggggggttctgtaataaggttgagaacaaaatacaagctcggtcagcgcatgcttctggctgcatcgcagagcgacgaaggaacggcagcttacccagtcaagaggcggcgagccagggtcggtcgtcatggtgagatagtagttccagcagagcattcccagcgaaaggttgaagggcacaaggtagaatagcgcccgcacattcatgttggtccagatgacagggagaatgctgaacggcgggctcccactcctgtcctcagtcaagcggccgatggtagggtcgagaggtgtgggcaagtcttgagaaggaagcgttgcgtagggtgacgacggaagggcaaacagccacggtatgaggatgtagttggccatggtgctgattgagccaatgaggcaccacgcaaaccaagagatccactggtcgttgccggccattctcaagcctcgagggtgtgtcccagtgttggcgtgtctccgctgctggtctcgctgtgtgctgtgtgctgtgtgctggtgtgctgttctgctgtcctgcggtgtcgctgcgatggggtccaatggtccggcgagacagaagcgcgcagccagaccgtttggtggccctcctgaaaaagcagattcatcaggcgaccccttaacagccttccgacccagttgcatctgataagagcgattgggcggattctgtccttgtcttcactccacaccgtcgacactgtcatatacccctcgttcgtccgtctcgtccatccaaggccagagagtaagtcttctcggtatgccatgcccccctccttgccagcaagacaccgcacccatggtccacactgccagcatgctcctggtcgttgtctgccagctgcacaacagagtgaaaacaaatacatcagcgaagaggcaaaaaaaaagaggctaaagtggggaggtgtgtgggcgggcctaacgaatgagtgaatgagtgccaggaatcgccccctcaatgcaaaacaaaaaagagttataaaaagtcagatcaggttgcgagttgctccctcaagagtcgagccacgatccccgaggaccgctcaaggcgagcagggctgggctggtcaatgagatacgcacgagaaaaaggttttttttcttgcatacaaaggaagccattttggtttatcagatctcgtcattgtcggctcaactggctcactttcccaccctcggtagccgcccgctgcatgtgtaacagacattccactcagcgctctttcttctactccgttctgcaccctcttagctgctgcatcgataactgtgggcgtaaggcaaaacgaagaaagcaaagaaactcccaagagacagtttcgcaggccttttcgacgatggcccatcccacgcaatcgcagtcagaccacgacgaggacgagcgtcgcccctttctctctccccctcctccgccatctccaccgtcagcgcacagggaggtgcatcccgcgcaaacacaagcccccaattatctaaccatcgacagggcatgctcgcccttgggcagcacaaacataaacacgagcaagaagaacgagattccccaaggggcgggctctgattccggaatcgcctctcctctctccatctcctcctcctgctcgtcctcgtccgcctcgtctgcctcctcatccgcatccgcttcggttcaagcgtccgatccagaggccaccgctcagcaagaggccgttccagtccaagatccacattgtcatcaccatcgtcaccaccatcgatcgcacaaacgcagacgcatcgagatgctactggctattttagcgcaactcggcctttttgtgtatttcggcactttggcagccgtcattgccaaggcaccatgggtgtacccttactcctggcaccccatctgcatgggactttacggcttcgttgcaacagaaggtaagctgtctgcctgctctgcgacgtctcattgagagtgaatcgagctcatagattatcgcctttaacgcccttagcaacgactcgctggctctgtgtcctgaatagccatcctgttgttgcagccgatagagaaaggatctcataagcggatggctagaacgtggcatgggttgttgcacactttggcctttgtctttgcagtgtgtggattcatcgccatctatgtcaacaaggacttgctgcacaaggagcactttcataccaatcacgcttactttggatgcgcagcagtgttcatctttttactgcaagtcatctttggattttttgtcgcttatgcgcctcgggcgctctatcaatggatcggtcaggctaggatcgtgcgcatccatcgcgttgctgggtatgtctctatcgcggtggtctgggcgacactttggctcgcagtgctcacgagctggatggaaaagaatttcgaccacgagtgggtctttgccctcggaatgggcatgctcgctgtcggcctcgtcggacagatcacaccctcacgtctctatgcccgtagccgcactgcagggcaccgacatgtgcgtccatagccgtcaaaagccaaatctccactccctctccatagatcatccatcgcatgtcattgtaccagattttgggcgcactcttttgaaatggtttcagaaacagtatcagattgacctcaaaaagtgcttacagcacagtacaggacaacctaggttgttgtgcaagtcatgaacccacggcattcaagacgcgtttacgatgctttatttcgcctggaatgttggtgaggcccagctcctgagctacagccatcagcagttgtgagctacccatgtcataacgcaggtgggcgaggtggtcacctctggtgagaccgaggttcaggatggcaatgggtatgcccgagtccttggcgagcttgaccagtcggaaggccgagtaggtggatagtgtggagccaatgaccagaagcccattcgattccagaatagcctgtgcggagacctccttgacactcacgggtatattctcgccgaaaaagaccacactgggcttgtagtgacccgatccacagttgaagcaggtcggatagttgaaggtgttgtagtgcagatgcccgttgtgatgatcgggcgatcgaagctcgacgtcgccatcagcattcattctggaatatagaccgctggtggactcgctctgcaggagctgattccattctgggttgcgatcggcgagtatctcttgaaagtcggatcggtcctgcacctggccacagctcatacacttgacctgatgtaacgtgccatgaagctctgtgacgttgctggatcctgccctttgatgcagaccatccacgttctgagtggtgagagtcctgataaagccgggccgggcgccttgcgcaggagcaggatcctgatgattctggacttcattctctcgaggcgtggtctggatcggtggcgtctcgaacagcgagggtgtctgtagggcagccagagcgtagtgggttggattcggggcggttgttttgacgggcggatagccaagaaacgaccgcgcccagtatcggcggcgactgtcgtcggaggcaacgaacgcttggtaaaagacgggtttgtagtctggattgagcgtgtagctgccattctgtccacgatagtcgggtatggccgagtctgtgctgcatccggcgccagtcagtacggtgatgttggggctgccatccctgagaaacgatgctagctcctgcactgcggagctgaagggcgggcttgctgctgcccgcgtgttggcagtgaatagcgcctttgagactgaccgtggagagattcgtagccgcatggcactgtggggctgtggctgttggagaatgggaggagctgcgtcagctgctgttgcttagaggtagctcttggtggatggcccaagggcaatgagggtcctgagtggatgtcgatcagctggactgtgccggaggtgcggaaaggacaaagcgcacggccaggtggagaaggttgtaaaaaaacgagcttgagcggagcgacaatctcgtgacattggagcaagtgcgatctcgtacagcaaaaaaaaaaaaggggaacaaacgaccgcgcgcattattttttctcgctgagtctgtttgttcttttttctcgcctgctcatcgtcgcctttcgtctttctcgtcttcctcgtcttcgttcgtctgtccgccatcgtcctcgccctcacctctcctccttcgtttgctcctccgtcgccttgcgccccttccctttgtcctttgtgctcttggtctctaccttccctgctcccctgcgactctaccgactcgtgtctgtgtgtcctcgagtgtttttttttgctctctcgcgaacagcgcacgctgtctgtcaagagtctgctcatccgcgtcgccccttttccttttctttgttctcttttcgtttcccgtgtcctcctgtcagcgactctgagcctgatacacccctcgcccgatgcttgcctctaccgccgtcaacctcaacttccacgacctggacaatgtcctgagccagccagagacagagcacaactgggccgccaaggaggacgccatcaagtccttgggatctgcctgccactcttccatcgcccagaatcaggaattcatcgtcttcatcaaggctcatcgcaaggctttcacggagtcggtgagtggcgtgtctttttggtgtttttttacggtgtgtcttcctcttgacacaggcggtcgcagacgaaatacggaaaatgccgctctccagccagactgtgtgtacctgacaaggctacacgagaacccccctactcaaacaaaaggtcctatcgacgaatatctttattttagcttctcacggagcggacccggctgacgggtgctgcgtgcgagatggtggaaaagctggcgacagccatgggccgtgattttggcatccattttgcagacttcttcacgagtgcgttgctgaaggtctgtgccagaaccaacaaggtcatggtctcgcgtgcagtcaaggccctgaacgccatcatcaacgccggctgcctggccctgcttcccaaagcctgccaggcattttccaccaacaacaagactttgcggatcgcctgcatcggtctgatttcatcctgcatcaccctgtatgggagccaagagctcgagccttacctagcctcgtttgagcccgtgctcaaggagggcgtctccgatgccgccccagaggtcagggactcgagccgcaagtccttcaagaattatgcacaaaagttccctgagcggtcagccttgtaagtgcatggagtggccttgtcgccttattgaacacccatggagatgtcctctttcctctttcccagttgccgggagtttccattatcaaccagcgcctgttcaagacatctgacccatcgtttgctctcgttcatgcacgatattctttctctctcacacacactctctctttctctcaaacaccttttctttttttttttgctctgctgctctcacgggcaacaatagactgacagctacactgccaagcaatgtgctcaaatacctcctacccgacaccagatcaacatcatctcaaccaagggtgtcctcgattagagcatcaacagcgggccgattcggtgctgatacaggagaactggctcgccatcagtccagccgggatctcaccagtggaccggccagagctggccccagcaggattggaccagtccgggccagaaccatggccgttgcggagcagggcccatccacctcgttcaaggtgcccacgacccatgccaaccagcacagcagctctacttcacagccctacgcctacaaccaatcacaccatatgcagtctcaatcagcacagggctcacagcatcagccgctgatgcggaaccacgggccagcaggcaggtcgggatccgttgcagattcagcagaaaacacgggcgctggtagcctccgcatggccgcgcagaggacacgggcgttgagcagtaacagcatgagctccagttccatgatccatcgctctcctacgatcaacctggcgaccaatggtgggcctcagagagtggcccccgcttcgtcgtacaactcggaatcctctcggaccagtcgccccacctcaatgatcggtcgatcgacaaaagttgagccagccgcaaaactaaaccggatgtcctccatgtcgtcccattctggacacggggcccctgcagaacgcgaacaaatgagcgctagcgagcgagccaaggcatattcagccaacttgaagaacgaaatggccaaccgacgtcctaccagtgacatgaataagcgagctgggatgggcgcaaggagagtcaccacggatcattctggatactccatgtacggacccactggaccatcgactttgctgtccgttgccaacacggcttcaagcagcgccactgcaagcacaacgtccacctcagcagcgacatcgacgacctcaacgtcgcccacgtcctcgacctcggcctctccgacgacgctccagccatccagccacgaccacctcttctcgtctttcagggcgccgagtagccctcatgtgccctcctcgcccccagagtcgtgcccttctcccgagcgtggacactctacacctccgaattctcaaccggttgaggaccgacccttgccagcaccgctctcgccgacgtttatggcacaggtctcgctggagggcgcgcatagttcgaatgcaactgagggtccacatgattatggtcaaccgtcgtcgcagggaccctttcagccgcagtctcagtcacacacgccactttcaccacgctctcccgctcactcggaagaatatggtctgcacaccattccaacgcctcctggatccgccaatcaggcaagggcttctaatacagcatcgatgccccatcaggagcaaggccacgttgagagccaggaggatgttgatatagcggatgcgtatctggatgcggatggacacccggacgtggaccaacacatgtcggtgcctgaccatgaaagtctgtttggcaacacggcgaactatctgcagatggagcaggagatctccgagctgcagcagtcgttccagactaaggagactggggcatcagcggcagagaatgaaggcagctcatttatggatgaggacccatcgttgatggaccacgaacagctggcggtcaaggcgtatgcagaggagtatgaggccacgctgctggcagccgaggcatcgccatcgtccccagcagcaacggcaacagcagcggcagcggcagcggcagcgagcccgccaagttcgcagccctccggccgcgatggcgaatgacacctgctgtcgcggcgcctcgctgccacggctgtcctgcacagtcctggtagggtgggtctgctggcgatctgatatttccaaaagtcataaacatagcctaaagccaagccacagcctgcttttcttttttttgtaaaacctatttcccttgtcagtcgttgtcactgcgtctgctcccctccacatcagcacactcacacaacacctcgttgcccatcgctcctgttccccatggcaaccagcagcatcgtagcagactttgaggcctggcagggcgctctcttctcgaccctggtcaaggccaccaaggccgccaatgccatccctgcgggcgatgtctccttctaccgcacgctcgatcgcgcctttgcggtcaacatggacgacgcctccaacgccacgctcgagctctgcaatggcctgctccaccaggctggcggtccagagggcgagctgctcaacgacagcgacgacttcaaggaccgcttccacctcatcaccgacgtggtcgacaacctgctcgagaaagtggtatgtgctgccactgggagtcctggtcgcatgcatgcgtgcatcccatgctgatcttgtcgcacatgctcaccttcaagcgctgaccctctattcttttgtatacacttggcgtgtgcctaggatgtggctctggatgagatgaagtcgccaaagaagaaggggaacgccctggttccccagagtgcgcctgttgtggcgttggccaaggtaattctaactcgaaagagatcgcatatgatccatggcgcagcggtccttcctgtcgactatcgatctgctaacacttttcgaaaccccctaatagagcaacaagctcgagtacaagctgatccatgctcaaaacattgcccgccctcagctgcgtttccccgaccctgtggacaactcgtcgtcaccgtttgtgcgaaaaatcacatccaagcccaacgcaaaagtcgatctcaactatggcatggatcggatggcgcccgatgcgtcttcagagttgatgtctcagccgcacccttacgagtacgagatcacacatctggaatacccccagcatatgtttgacccgagacccgaacagctctacttgccgttcgacacgacatcggccatctgggtagagacggaagagcaactccgggacatgtgcaagtcgctcgagatgcagcgagagattgcgatcgatttggagcaccacaattaccgttctttccagggctttgtctgtctgatgcagatctcgaccagggaccaggattatgtcgtggacacgcttgagctgcgcggttcgcttcacttgttgaaccaatccttcacggaccccaatattgtcaaggtcctgcatggtgcagagagtgatatcatttggcttcagcgggactttggcgtgtacattgtcaatctctttgacacctaccatgcctccaagctgcttggtaagttttgctggtctaagagaccttttttttcacctggcggtttgtcgcgtgcagattgtttaactagactggttgtatcttttatctaacatagaatttggaagtcattccttggctcatctactgaagctctatgcagactatgatgccgacaagcggtaccagctcgctgattggcgtattcggtaagttgtagaaagatatttccactcgcagtggacatttcatgaatggctatgagtaatatttcggaatttggcataaacggaattctgactggcttatttctactttctgcctttcgcccgagcagccccctgcccaaagagatgttgagctacgctcgctcggatacccactttctactctacatctacgatcgcatgaggaacaccctgctcgacaagtctaacccaaccacccacaacctgctgcacgcaacccttcagcgatccgccgagacttccttgagaagacacgagaaggaagtttatgatgcagagagcggagacggtcccaacggctggaggaacatgtactcgaaatggaaccgatccctcaacaaccagcagtttgcggtgttcaaggccctgcatgcgtggcgtgaccagacagcgcgtgacgaggatgagagcattcgatatgtgttgcccaaccacatgctgtttacgctggctgaaaagatgcctgaggaggccgccaaggtgctcgcatgctgcaaccccgtcccaccctcggtcaaaatgaacgccacagacattgcctatctgatcagtcgaactcgggcgagtgtagcaccggtgttgggcggattcaagccagtggagattgatgtcccagtgcatgtccgctttgaccccaagacaggactccaaagtacagaggaaggtagaacggccgctgctgcctcggctgggggatcaacaacgacgacttcattctcgacccgacccacaccgctcgaaatggcaggagaggctcaggggggaagagtggttgctgcggcgtcgtccagtctttttggcagaggaggctcacatgccttggctgaacccaagctcttgctggatcctacgcccctgatggctaaacgctcaggactctttggcggcagttcgtccacccagccctccacagcagaggaacaggcgaaggagcttgctagacgactcatgcaggaactcgaggtcaagccagtggggcctgcgcctgttttcgcgcaagtcggcacccaagcgactgtccacgtcccagccgtggctgacgaggccaataaggtggaggagcaggagcaggaggtgctgttcacgccccaggaggatcgtgtgacgaaacaaaagaggacggatgtgctcgtgctgtccaacatgtccaagaagcgctcgagagccatcgacgaggagcgggcagagttggagcaggaaaagactgggtcggacgtttcgaccgctattgccgttgacggcgaagagggagaggtggacgtggtcgagatcaagaaaaagaagaaaaagtcttccaagaaggacaagggtctcctgtcgtcggacgcagcttccactccatcgtcctctgcaccagcctcggacgatgaagccttcaagccattcgattacagcaatgcgcccatgtctgtggtggaccagaccatcgccaactctagcaagaggaagcaaaagaagaaggctgacgccaacgcgccccctgaacgtaagttgagacactggtctctctggctagccatttgcattcaatggcacacgttttatagttttgggtatgtcctctccctctaaccccctcttttattgatatattcatatattccatgtattcatgtagcatttgatccctacaccaagctggtcgagaaggccgatttcaagaagaaggacgccaccttctcacgcacgccaaagtctggcgcacgcagcatgacatttggcaagaagtaagtagtgttagggctacacttgagcgtgcagtggcatgtgtcgacagcaaaaaataaagcaacaaaaaagcaaaagaatggatatctacgcggtggattcggttttggtgtccatgctgcgtgtgcagcgtggatgagaagaagaggcaaggaaagcgatgaagtggggcgtccacgaattctcaactcgaaatggggtcataaaaggacacgcccgtgtcgcactgtggttcttttctttgcaactattttttttgtttgctctctttccttctatccatccccatccccattaacgtctccctgcagcaaccatggctgcacgttcggcacccagcaacgtcccactgcccggcactccggatctggagcgccagcctcttatcgccaatcaaggcaacgccgcgaacaacagcagcaccaacggcaacgctccatgaagtgaaagcgaattgttccgatggttggttattgcatgtgtggcaaaccgtttatggccattaatggctttactattcaagcggccagacccttcatgcgcacgtgtatgcatgcaccctgcacaatgctgcggcgatgactggctagtcactacactagaagtttccagatctagtctagggcacataaataggcacacgcgtcgagccttggctcgacaaccaataaaccattctcctttccactttacctgttgttgcatcgcccattctcaacatatccctcacctcaacttgacacacaccttaactcatcacgccagtatgataaccgagccttcaaaacgcgaccagattgacaagcgagtgcctccagaaatctgggaacggatctttggtcgcctgtacccatcccagctaacccggttgtcgagagtcaacaaaaactttaacaagatcatttcttctatgtcagtgtggtcctacatgttctcaagagcctttgggacaggggtgcgacttcgcactcttagcaatatgcctgaatccaagagctacatgctgtacatgtgcgcgagcagcctttatatatgtgagaagtgtcttaactacaccccagtggagtccttgtatgcagggactaggggctatcggtgctctgatcgacttccaaagagaagtcttgcaccaatgccaacgttgaacaaggacaatctcatatacatgggacaacaagtcaacttggactggtatatctggatgtgcccagcctgtcgtaaagcagtacgttcgacgggagaggttggtgacgactcaaagaccatcgataggattcgttggtatcgagagcagccttgagagggatttgtgaccacagcaacatggtgagcaatcataataaacttgaacaaatcctaacaaaagcggaaaaagagtcgacgtctctatgaatgaaatgctacatggggcactgccgagaaaaaagctgtatagggtaactgcgataagggcactttgcaaatgagttcaacttcagacttgaccgtgcagtcacggtgttcgtttatttccttcaagttcatctacacgttgctaaccgttcgatagtcgcttgatgattttcaactgtctcttggagctgacaattttgccgcgaatctggagatgatcgatcacattcaacagagcaacaaaaaaaaaaaaaaaaaaaaaaaaaaaagtaccagtgaacgtcaaagctagaccagctcgaggaccttaatcacgcccgagctgtttgcagccaacagaatgttgttggaagtgttcttcttccagcagaccgaactgacaaactgcgaagggtcttcatccacagtatcttcgccctaggaaagtcatcgccagagcaatttgccattagtcaactgtgcaacccagagtgtgtgacaaacgcggacacgaacctcgacagttctagctcacttcacttacagtcaccgggttcgaattgccaaacttgacggtgacgactggatcccgaagctccttgtagtatgtgtagacggcattgttctcgcttccgcacgagatccaatctcctgacgcgctcagtcccacaaagttcttctcgttcatatgtcctgtataagtgcgcgcgcagttcatcctcagcgtattccatagcttgagagtgctgtccgtggacgccgacaccaactcttcgcgtcccaggaacttgacatatgacactgccttccgatggcccttaaagatgaacagcggctcgttcggtttccgcaggtcgtaatagtgaatgtgatgatccgcacttccgaacgcaatgtgctggctgctctctggattgaacttgacgcagcaaatattggccttgctctcaatggtgcatgctgatgccttttgattcgtcgaccagatcttgaccttggtatcatcactaccactcgccaaacgtgtcgggtccgtgcgcgaaaagtcgacactccacgcccgcttctcgtgttcgtcatagttgagggtgttgatacctgtctgcgagtcccagagcgagacgattccctcatagtccgagctggcgatttgagatttgatgtacgaattccacgacaaacagctgtagggagaatcaaaccacaagaaaaggtcgttaaactttgacgcctgaaatgttgccatggctcatcatggtttttccacgagcaggcgaaaccgttttccgagaggatcaatacctgattttgctccgacatgtcatctctcgcacggggtaatgaaggacggaggtgatgggctttttgttgggcggataccgcgtaggccgcgaaagatccgttccttcatataattcagacctgtcatcctctctgagactcgttcctgcaagccctgtcttttcgatgcagccgtactcaaagatcttgatctttttggtgacaccagcggttgcaaagtactcgtcgtcccgatcgaattcaattgacgaaacgatggacgacgtattgtagatgtcgccatagcgcagtgtgttgacgtgctcaaagtgcgagaattttgtgaacttggatatcgtggagcaaaagcttgaaagagcagactctctcctcgcggacgctatccaatcgcatcaagttgtaaagagcaaactgccgttagcggcgaggaaacgtcgtaaaaatttggtcatctcgctcttgccagaaaggtgttggacgctatgaactcacaactcagcgagaaatcaaagtagcatctctgcaagtcctcaaagtgctcagcgactcgcttcttgttgacattgatctgcttggcaatcttgaggctctggatgttggtgtcggacgtgaccttggcggtattggtgttctcattcctgtcctcacgttccaactgagcatggcttcttttggatcctgcctgtggaggtacagcctcctcttcttcctccgagacctcattggggactggtacgccgccagaactgcccatgcactcgagctggtcgtcctcttcatcgtccagtccctgtgtgatctgatatccgctgtgctgctttaacacatccaacttgtcctgagcctttctcatgtcattgtccaaacattgaatctgtgcattgaggcgtgccagagcctacaaatataaatacatttcgagctttgtgagataagcgatgccctccatgagaatgcacttgtatctatcgacgcatctaggttgacgttagagctgaggggttaacggcacgcaacctagcttacctcttctttttcagcccgagtgtttctgagaaagtcgagcaaaacctccagctcgacttgctgatccgttgattctaatctcctcttcttggccttcaaggtagacaacatgtcgtcgatttctacgccgccaaaagatcccgtgctaccgatgtcagtatgtggttcaacgtgtcgtaatcatccatcctgaagtgtcccagctcggacagctcaccttctcgagtgtagtcgttttggctgagaagatcgctccgtatttttgaccgaggctccagttcttcggaaacatcgagtagccctgcggagcgctcgattatgctgtttactgtgcacgttaacaagacacggttgttgaaagaaaccattataaaaaaaaatgaaggaaaatatatgctcagtataagggaggcatacgcagatattgacaagcgcacctccgaacatgtacacagtcttacgtaggaagtttggaaagatctgatcccgggtcaaggtgcttcgacacatggggcaatcctgcttttcgcccagatgctgagtaatacaaagatagctacgatgcgaagcgtgagcgtgattagtgagacgccgctttgagatcagagtttttgcaaagcaaactctccagaataggaacaccgacgaggacacctaccagaacgaatggccacagcgagagatgaaggcctccttgatcaaggctcgacagatggggctgttagaggcaaggggagcggtgcgaggagacgggcatttgcagacaggcaagtgaaaatgtaagcgtgttaaacatcctgaacatgacacaaggggtttgcagtgttgcagtgttgcggtgctggtgtggtgaaagggaaagcaagggttgggacagtgtgctcatgatcgaggcccgtatctcttttttttccgaggccatttgcctccttatctctgcaaccatgccaccatcctccaaccatgctgcacagtacacaaggaaccgtatctcaccagtgataatcgctggagaaggagcccagtcgctccgccagcggtgcagacggccccgtccgcttgtcctgggcgtgggtcaaggatgctggaccggaggggctccctgccgcgccaccaagccttgtggatgtgaaccgctgacgtttccgcacaacggaccttggactactgttgtggctactgttggtgctgctgaggttactgttgctgggggtatcttgaaccaaagcgcttgagccatcgtgcagagccaaagcgctgctgctggtgctgccagcggcgggtggggcgctgccaaggctccggctttggctctgctgactgctgctggtgcttgcgatgtcgaccgtgtcgacggcggtgaccatgctgctcatcctgctgaggctgctgctcgggcgcaagggcgagggtctaggtatagggggcgagagcgtggcgaggttggcgagcgagctgttctggctggcgggcggagtgggcatggtggcgggcgccatgtcctcgctggagacggacagggtgtccgaggacgagggcgatggcgaggaggatgaggacggcggtcgctggggggtgtctggcgggtgcgggcttctgtcggccatggatggacaggcgggcgtgcgatgcgatgcggagagaaatggacagacaaagggcaaaaaggagcaaagcgaggtggtgctgtaggagtctgaagaataagaagaaaaaaaaaagaggctcgggtgacgtaaaaaaaaaaggtcttcgctatgctactcagctaacttgctactccactactagacttactacgcaaccacactactagacttgctactggactatggcccatcagcaccgtggggccatgtccaggaggagtgccctcgctccattcaggctgcaaggagggtcttctgcggtcgcaccaaccaccttgcactctcccgcatcccatggagagatctgcgctcgccacggacgagccactggccacagcgtcgtcggtcgacgagactcgtcgttcgccaccgtcgacagccagggcatgtccgatacagcactgcacgtgcgagtgcatagtcgagggacacgcgaggatgcaagcaggccatgttcacgagaaacaaaaaaaaaaaaaatgtatttaaatgcaggtcactctcgcgtccttctgcattcttctttgccttcctctgcattcgtcgtttgccttctttgttgctgtcgtccccccttctgcctcgcgtccatcctctcgtccgcggctccttcttccgtggccttcctctccttcgcctcttccaacacctctcttcgccctgtcctatcatccacagctcatacactctggcacgcacacgcacgcacgcacacacacacgcgcgtcgagcagcgagaatgcaatgcgccagttcaccatgcacttcaatcgcgacgcgtccctgcagcgggtaatgacaacggcaggacaccattccgtgacttcaggcactgcattcgcgcttcctgactctgcgggcatatccactcactttagccatggtgtctgcattccactaagaacggtcggggaatgcgcacaattctcaaccctacaccagcgcatgcagaaaggcagcctgtggcgaccagcaggttcgttctttttgtctctctgtctctctcgcttgtttccagtctctgctgtcgtcaacgcccacgaccttacctgtacgctcaacctaatgctattcgccctcctactgtaatgaaaggaattaggcgcgtcggaattatgaatcgtcagtgcccgaccccagtgccctggcctgctgttgacaaacagcgacaccactactactgtcgatgccctcggattccgtaacagctgcaaaggtcggatgcaagcagcccacgcgagtctggcacaacaagaggccgactacagcgccgcacacgaaaaaaaaaatagctttcgcggtatgtactaaactcccaccagcagacagtcctccatccccacagtcaaacacacatcctgctctgcacccaggcgtcgcctcgactgacataatggaatcaggatcgggcttgcaaaaaaacatagtcgaggtcaaatcggggttcgtcacatcgtgcacgttccccgacagaggcgcgaccaggaggccagaaggcttacgctgtatggctgctggtcagccgcagaacgacaccatgggtgtctcggcatcctccgcgccctgcgtcatgtctggatgggacaggaggtagcggcggacagacgagcacgatcgggatcaaggttggcgaaatgatttcgtgaaagaacacattcgtgaaaggtggtgtttttatattcatgaggccaaggcagggtgttctatctggtctatggtacagcaagtgaggtgggggcatgatggcggggagtaggaagggggtacaagtacagttgcgcacagcgagaagcaaacaaaacgacagcagaacacaggcacaaaaggacaaatggaaaaaaggacaacaggaacatggaacacaaaaaaaaaagaactggactggggatggagaattaaaggaagaagggctcgtgctgcaggtatgcgcgaatgcgcgtttttagcgcgcagcggcgagagttagcgagagtggaagagggagaagggggagggtaagagagagagagagagagagagagagagagagaggggggggggggtataagctcaattctgggcttggtcattgtggaatctctaattccttggaacggcgcagggcctcgacccaagcctgtgtctggagctgccggcgcttatgcgactgaagctcgtccaaggcctgggcttcgcgtgcgcgctgcaagaggcagaatgcctggaagattcggtagcggtgcgtgtgctcctgaatcatgtgctgctggagcgccatgctgtgcctcagctgccgcttgtactgcagatctgcctgaggccgtggcacgatggacgtggtcgagctggtccacaccgttgcgcgctcttgcctagccaacgagggctcgttcatggcacagactcctgtttgcgcacctgacgcttcgcccgattggaatcgactactattcggctcggccagagtggtatggtttgcgactttcgtggccgcggtccctgcagctgactgccgaagacgcgcctgatacttgagtcgctgctggcgctgcttcctgatgtggaccaggcttggaagcacaaccttggctagttcagggacggaggaacctccctgggcatgctgcggaggaggcgttccaggagttgcaggacggccaagaatctgctgcagatcaaggcgtggtggggctgcggtgcgtgtggggatgtggattgtgtttgggtctatctctagccgagccaagtcggtctcattcatatctgaagcaagctgctcggctgtgccttgagtggtggtggggctcggcaacggctgcttttgaagagtactaattttttgcaggtactggatcctctggatctgccgggcgtggtgaagcgtttgagcctcgagcatccgctgcgcaaggtggaaccgcttgacagagtgcagggtctgacgctgatgctgggccgtccgactctgtcgatgctgcaactgtagcaactctatgtcgcgcaggcgttggcagtgcatgatctgcagctgtttataatactctagctgggtggcgagctggtgctggtgcttctgaatagcgtctgggctgggtagatgtagaggatgctcgggcctggcaagctgggctctgatctgctgttgatgctgttggtgcaagtcgacgctagattgcagctgctgctctgctgaggctgcatgagttatcgcgggcgcaagaatgccagactggcttgtgctgggtgaagggggagccgaggacagcacaggagatatgggagacatgactgagcaagggggcgatggcgagggcgtagggtgttcgtggggggcgagaatcaagtgcggcgtgttttctgtgaagtggtggcttcccatgatctgagaatggagaaaaagaggcagaggagatgggttagagattgaggtgagagagagtggagacttggcgggcaatgatggcatgggtggcattttaatgtcttggcccttagccttggctatggctctggcttggcccaggccaagttgcgcatacgaaacaatacggtggacagcaatgtggacgtgaggagggagccaagacggggctgtgccctgaggaagcaaaaggccgagggctgcactgccaaagatatatctggaagaggtgctcaaatttgtgatagagctcacgcaatggatgtggacatggatttggatgtggttgtgaaactgtcgaaataggttggctgtggactgggttgtacgactgcgacgtgtcatttaacggccgctgcatcatcgccaaggcgaaggctgaggcaggacgacccagggagagggagaagaagagaagcaggtggtgggaagtgatgcgaaggtttgctgaggtgaagaatgttggcgaagctactgaggagctaggcgatgtgcacatcatgcatgttatgtgaataagggggcgcctttttgttaccttgggcgggttccgtttggctgtgtgcctgagagacgggtgaggagcagactgactagcctagtaacgcaactcaaggtgagcagggcaagcaggccagcagagtcgagtgggagtggacgagggcgcgagtgcttgagaagcacgggggaggtgggagagacgaaagagactttggctggatgctgagagagagagagagcgatagaaagaatagcgagagaaagactgtgagagaaagactgtgagagagtgagagagagtgagagaaaaggaagagagaggaggctcgggtgagagcaaacgagaagagtgaggcgaagagagaaaagagagcgtgtgtggaggggcaactgtctgtgaaagagggaaggagagagagcgagcaagcgagacgagacagaaaagaaggacgagggactggaaggcaaagaaaaagaacgagcgttgctgggtgccaagagtccaagcgagacagacaagtatttgtatttttattttttattttgtgcgttcggtggccatggccctgcatgtgcactgtttttatgttgtttcctatggatcgccatatgggatcacgcagtcgggtgggacaccagcgagtcgcatcgaatcagatcggatcgagagagccatttgcgatgcgccatggacagcgacgagcgcttttttttattttgtttgtagctcggtctgtagccctgggcacaagcagtacgatgcagcatggtccaaagcggccctttattttgcattttgtttgttgttttggactacacgcggatggaacagtgtggagtttgaacacgccagaactctaaatcgcccctcccgccattgagtgctattcagtcctcctcctcccccttttttctattcttcgagtctcgtctctgctgtaccggatatcggcctgttgttctcggtgtgtgatgcacgaccagccgtcatggagcaaaacagagttgaagagccgatcgatgggcatgacgctgcatgggctttggatcacactgcatagggtggtctgtccgccaacactgcgcacactctccgtcgctgcatcctgtgccgtaatccatcgcacccgacacggcctattctactcacgctcagctgtcagcaaactgccgcactcatgcaaccggatcctagtgcatgcataagcgcagaagaaaaaataataatggaagacaggcagatgaccatagaattggtgagcacggatggaaccatcagcccaaataagaaaacagctaatatgacacacctgcttagcattctgcgtttgcttatgccggcgaactgggaggacaactcataagctgacagtgaggcaccagccgcggagacgggatcagaggagaatggagctcaaagcgtcgcacccactgttacacagtgttttcgcatgaaagcacgacgtgaaaaaaaaaaatcaacgatcgatccacacacaaagggctctcacgaggaaaggagacgcaaaagggatctggtttgtcccgatctcctggacacctctcggaccctggatttgattcccgcttgctaacaatttttcgcactgtgctgtgtagcgacagaggtgagaatcaaagctatttttgggacgaactgacgttttggtcgtccactgtgggcacggaaggttctgtgaatcggatcagacctggtgccctccgaggaatgctggaaagcgcaatcgcaagaaggtcaggatgagccagatgccagcagcgaggaagaggggcgctgggttgtcaacggcagatagcaacacagggagcgactgagcgctgtcgaatgcaattattccgtcctaaacctggtctgattgatgaggaaactaacccaggaaaatgtctctgccggattattcctcttttcactagccagcaccgttactctctttctcaactactcgatccatagcccattgcacgcttactcctgcttttagtcttgctttcccaaattttcggttgatctcgtcagctgcatcgcctcatagaacaaaacaacatgccagtactgcaatctgtgaacagcggcatccaaggtaagaatgtgatacaaaggacgtttttttttccacgacatgtgagtatatgctaattcactgcgcgtggtcccgcaggtgctgccaccctcagccagggcgtgttcaccaagagcaagggattctttcaagagttcaaagactttataagcaaaggacatgcttttgacttggcggttgccttcatcctgtccacggctctgtccgcggtcatcaagtctctgtaggtcaacgtttctacttttttttttttttttttgctctgatctctgaaccccatgtcttacgtgatgtcattttagcgtcgaggatattatcacacctctctttggcttgggcaacaaccgcaacttggatgagatgtttcttgtccttagatgtggacgagaggtcaagtcttgcaagtacacaacaagagcattggcgcaactggatggagcaggtagccaatacatccacacaactacgcccattccactacaaatcgtgctatgagtctccgttcacgctgatccattttccattgtcttgatttttgatgccacgggcaatagtcacctggaactggggccgcttcattaacaccatcatctatctgcttctcgtcggtctctttctgttcatcatcatcaaacgtaagctgccgagtcagagtgatgcctcttggatcatctacccctcgctgtcgtataatctacgctaacgcgatcctgtagtttattatgtcttgaggcgcaaacagcaggtaaaagacaaactttgccaatactgtctgaaggatgtgaacggggcggctgttcgctgtgccttttgcagttcctggctagaccaagatgtgcggcgcaaggttgatagcgaatttttctccggtggcggttctggagtcacctatagcaatatgtccaacaccacattgggcacccagaatggcctgatgcgagaaaaaaactcgactgacgtgctgagggatggcacggcggtgggaacagcagcaggcgtggctgcaggcacgggtgcaccgatgaacccctacggcaccaatgctgcagttccgcagtcccgtgtgggcgccagtggcatttcctctgaccctagacaggttgccgacatggatccgacggacaacacctacagcacgggcatccgacccccgcgcgcctgaggtgccaaaagatggatcgaataaaaatggagtatgtcaggtgacagcactcctctgatgatgctgttccgcctctcgtctccgactcgacacactttttttctgttcaacagtcgctgcgaatcatccacctgctcttgttccatcatcccttgcatccgtctttgcagtcgccactgctgctgcgcacacaccccgcaccttgcccctgcacccgcgtctgataccgacacgcacagacacacactcgcgctctttcgctctcgctttcgcccgcacccgcaccactcctcgccacacacacatacacacataccgacgcacgcgcacaaaacgatccagccgcacctcctcaacagcatccaatgcaggcgctctcgctttcccagcaggtactttcgcctgccagcctgcctcgtcgtaaaacagcaccggtccatcaccagcgtgaacagcccgattgatcctcctcctccatccctgctactgaaaacccatctttagatcgctgccgtcattgttgaatcggcctcatacctcggatcactcccccttccggcgactgtagccgccagccgatcgcaccatgtacggagcgctacatctgctgtcaagtcagccgggtccaagcccgcagcagccggcagccacatcccagagtgcttgcgcctggctgccaatgaaggtgcattgtcactgtcgacgctgcaccaggctgtggctgcattaaagcgagatgctcagggcgtcacggtggcccaggtggagatgcttgcgcagaaggtccaaggtgagtttcactgacgcaaaaagagcacaagctcaagacttcagcattctccttctttctctcgcacctacctacctacctacccctacacacacacatgcacacacatacacacacatacacacacatacacacacatacacacacacacacacgcacccacacgtccttgctcaccacaaaacgcacttcaacaaaaacgccatagtctaaccccacaatgcactcgtacgcgttttaggtcaattgaggcagctgggatcgcgtcaggcagcttctacagcaagaggccctagctcttcgcgaccatggctgcaaggtacctttgggatgcgagaatcaggactttcagtgcagtgctagttacttttcaaggtccactagtctaacaaatggcgagtcaaacgtcttgcatcgctcttgtcccttgctacctaggtcgcctactgtctacacgaacgcagcagcagcaccatccggctttgaatggccgtttgttgccaccaccagaacgcggatgtcgccagtactcgtccttccgatttatcaaccaccgtaagctgcagaaactcgagcaggaggccatggctaatccaagcaacgcagctgcgcaggctgagttttacaaggtgggttcaaattcgagctgctgcattcatgcatgtcggcccccgccaaacccaacacctgcagtcttgtaatgcggcgtacgtgagtgacacctaacaacaatatcttttactttaggaactgctgcgaatcgacgactacgttggcatcatttcgcgtttcgagtcaggaaagtttgccagttcggaagcctcgctgcagtactatgccactgcgttggcaagaacgaaccaggcagagcaaatcgtccccaagattctgcagcgcttgcagcgtcaaccacttgctactgaatcggaggctcttctcagcaacatcggacagagtgcgcggcgtgccaacactgtggcaatgtcagagagtagtggcatcaatggaggcgctgcagtagcggacgccatggccaacgcaggcaacaaagccaatccgatatacgtggtcatggatgacaccaagagtaagcgaaaggcggctgggaaaccaagtgttgaatacctacgcagtacagtacagacgtgagtccatgccgtgtcactgactccaccactcttgcactcgcctcactagcaaccaagggccatatgctttggagaggattacgctggctcggcataactgtgacctatgcgttttgcatcctcacgtttttgtcgctagtctttgaaaactcggggctgttgaagccggcgcccagtcagacagagtttgagccgtctgcagacaacaacgtcaagttttcagatgttcaaggagtggacgaatcgaagcaggagctggaggaggtcgtcgagtttttgaaggatcccaacaaatacaaccagcttggaggaaagctgcccaaaggagtgctgcttacaggccctcccggtacaggaaaaacaatgttggcaagggctgttgcaggcgaggcgggcgtaccgtttttctttatgagcgggagtgaatttgatgagatgtatgttggtgttggcgccaggagggtacgggaactttttggtgagtcgacttcaagggtcaggagcatgtatatgagttttgcacaaaaagacaacaatcgttaatatctcgagcaatgcttccaacacatcttgcttagctgctgcaaggagccgggcccccagcattgtatttattgatgagctagacgcgatcggagccagacgtaatcccaaggatcaaacatatatgaagcagacgttgaatcaacttcttgtggaactggatgggtaagagaccatgctttcaatgcgttcttttgacgcgcgacagcagaaagcgcctcgatcgaccgagttcctcgatatcgttgtgctcatggcatattcattggacgatctaggttttcgcaaacggagggcgtgattatcattgctgccaccaatttcccggaactgctggacaaggccctggtgcgacctggtcggttcgacagacatgtcaacgttcctcttcccgacgttcgcggtcgtatgcagatcttgaagcatcatttgaagactattcacactagccctgctgtggacatctctgtcattgccagaggtacgccaggtttctcgggcgctgatctagctaatttgatcaaccaggctgccattcaagcctcgcgcgagggtgttgcggaggttggcatcaagcagtttgagcacgccaaggacaagatcctcatgggagtcgagcgtcggagtcaagtcgtgaccagcgagtctaaaaagttgactgcgtatcacgaaggtggacatgcccttgtcgcactttatacccccggcgcaatgcctctgcacaaggccacaatcatgccgcgcgggaatgccctcggagttacagttcagttgccggacatggacaaggacagctttacgcgaaaggaatatcttgcacagctcgatgtggcgatgggaggacgagtggccgaggaaatgatctttggagcggagaatgtcaccagtggatgctcgagcgatatcgtccatgcgaccaaggtggccaagatgatggtgactcagtttggaatgagcgacaaggttggccccgtcgctcacacggaggaagatatgatggtgctctcgacccccacaaaacagctgattgaggcagagaccaagacgctgatcgagtcagcacaagcccgggcgacactgcttcttaagactcacaaggaggagctccatcggttggccaaggcgcttgttgaatacgagacgctcacccaggaggagattcgccgggctattgaaggaaagccgatcgtgcgttgattgcacggcgctgcctctcttcacttcctcgtcttgatctgatctcttgagctattctcaacgtgtgataattttctagacagcaagtaggggcatgagagtaaaaaatcaaccaaccactttagaaaccgtccctgtccctctttgacaactgttgccaagcatgcgagtccatggtgagtaaaagacaggttcacgttgtcggattcgcgactttctctattgtaaagggttgggtaggattgggttgtgttgtaaaagtacaggatgatatggatccatgggtatgcaaaagccaataacactatatgcgtctatcgagtgtcagagtccgagatgggcaccatctcgtaacgatccgaggtcctctggcgcccttgcttttggttgccaaggatactggagcggatggctggcgagaacccgccccgcaaaacaccgttgtcttcgctggaccgtgctttttgaggtgtgactcttgaggagctgcccacggatgcgatggtaggcaggtccgagttagtgggatcaaagacctccatcagtagacccgaagattcctcgttcgagttgcttgccatgttattgctgccgctgttgttgttgttgttgatactactgttgctgttgccactagtgccgacgccgttacttgtgttgttgctgttgttcccgctactgctggatccagtctgaccacctccaaggagaatgggctccatctcctgttgcatgcacacgtactctcctccaaagatcatgataccgcaggtggttccgttcaacgcccaccacagaaagctagtcggcacgtggtccgagtagagtgttgtcatgaacacatggtagagcagtagtgtgagcgagaagtcaagcaccagacgagcacgggcaacgatcttgaggagcaagacaacgctatagatggcatggacgtaggctcagtcagaattccatttccttgagaagcaacgctgagttgagcgatttagtaaggaagggggacaaagacagcagcaaaagagagtccatgtgtttacccgaccgccgagttgaggagccatgcgagacccaggagcatgccttgagcattgtcggctcgaatttcacggtagttgaggatggcatcgagggtgatgtcggctcctgagaagccggagacgatgtagatgatggtggcgaccgagacgtaccagatggactggagacacactatctgggactaggagagaaagaaggaagagcgacgggcagaagaggaggtttccgacggtgagtggattgtccgtcttggctctgagcctgtcggcgaacgtggctagacacagtgcagtcggcgtgcgtgcgagcgcgtaccaggatgagcacgggatcccactgtgtggctctaaaggacgagctggtcgaggccatagacggatggcgctatgaaagcgggttgaagtcttgaggatgctgtggatggtcgctgctggggttgaggttggggttggagggtgaatgtgcagaggaggaacgtgtcagagagtgcaatgcggctggagagtgcagagctggagagtgtggcttgggatcgacgcttggccaactggcctagttctacgatcaagatcaagatcgttcgtccgagtgtatctcgcgcagcgagggccaggcgacgaagcgcccgctctgcttctctgatcctcgatcgatcgagaaagtgcccacgcgttaccgcttctagttcacatcctttgcgctttgcagcagagtggttgtagggtgattttgtttcctacatgtactaaagcagctcctctcgatatgttcacaatgacaagcccagagcgcggcttcatcggctccagtcaaggacgcggatgtcctgacagcatccatgccgggtgccagggacgccagcatccctgtcatcgcgcgatccaccatcggctggccagacaacagcagcagcaacagcatacaatgtgtgcaggccaaaaggtgattaaagggaggcactggccaatccaatcacgattttttatgtctcgactcccgcacctctcgagttcatttttttcttcttttgaaccttcttctcgtgtcctgatcctgttcgtcctcttcctcatcctttctccccagcttcgtcctcgtccccgccctcgcccgccccactcctctctccagataggaccctcggctcgcatgtctcaaccacaacgtcgtaaacctgctgctggtgcagccgacggtggtgccatcgctgctgacagctcggccaccgtcgccagcagaaatgccgctggaaatgcccagcgagcggcagcccagcagcaacaggagccccaaacactgcgccagaccataatgcagatgctcactcgcgccatgatggcctatgccgtcatcactctcttcaacagtaagcagatgcctcaccaagggattgcccagtacccccacaagcttattccgcttgtaccttctgcgtactcacacactcgctcgacgtccctttatgaacagcctttgcaggaaagaacagagcacctcaggctccaggacccgatgcgattgtcaccacgcacactggacctgatggcgttcaggagattgtcactggcggagcgactggcccccagccagagaagttgtttcctctgtggcggccccagaccaaagcagtacgatattttttttttttttttttttttttcggctgctgccactcgtcctctgtcgatgctgtaatatcttcggtatgactgggacatgtactaactaacgatatgcaacgctgaactcttcccgttgttttcactggtgcgtaggacatgttcgtctacgtctcggaggaaccagactttcaggactttggcaacttgaacagcctcgtctggcgaaccaacgatattgagctcggtgattggaacgaggatcgtgttgtggacctgtcgattgttccctccaaggtaagcaaggccacccgcgaaggattttctccaccgcaaggattcatcgcctgagccaagaacatcgtctttattgtgtcaccatgatagcatgtccagaacaacggaacattgtacgcgcacatctactttgctaagcagcccgctgtcctcgacccgactgtcaagggcttcagtgccgacaaccgcgtttatactcgcaagagtaaggaaattgacagatactgccaatttttcatgcgtcatgagcgtctcctctcgcgtgcggttattcattctttttgctgactgggtgctcaacacttttttattctacgcgtagtgctcacccgctactacaacaagaagaaggagttcaaggtcaagaagctggtgggtgccaagcacgatgaagcagtcgagccagaacctgaaaagcaggcagaggaggtaagagaccgcccaaacagccctcttgggaggttcccaatttcgcggaatcacaactgcaagtgtatgttcagtcactcatgaggtatatgttcattcaaataccaggcatccgctccgggctcgactattgtctcgtactggcatcagaacttgaccatcgctgtcttgtctgatcagaccattattccttttggtgctattccaccagagatgaaaggaagtaagttatcactcttaacaatcgggcgagagtgtgagtatgtgttctcgaccttgatgcttacattgctattactcccatgacctagtgtatcaactggaaagcactggaatgcgcgatgcacacggtaacggatacgtactgccagcggtctatgtgaacgatttctggctgttgaaggaacagatgtcggccatcaatgagactgtgaagtaagtgcaaatggatatctgtccacccacgttcttgtacacagctgtggcatcggccatgccatgcaggccatgggctgatattggtgttccattgcttcaatctagagagcttccccttcgcatcaacttttaccccatcagttacatgaagctgcagatgtatgcctccatggatgtgggtatgaagaagcagtccggattgatgggagggaccggaggagagctggatgaggtcaagcgtatgctgatcgagaccaacccctatctgctgttgctcactgtgattgtgagttgcttgcacagcgcctttgaaatgctcgccttcaagaatggtatgctgggacctttttttttttttgcgtttgtatacgtggatatttgaacagcgtactgacaatcgtttgcttgtgggatgaaccaaatcagatatcgcgttttggaaggacaagaagggcactggaggactctcggtgcgctccatcttcttggatattgcgcagcagatcatcgtctttgcgtacttgatggacaacaaccaggacaccagttacatgatcttgatcggtcaagctgcgggactggccattgaattgtggaaggtcaaaaaagccctcaaaatcgatattgttccagcgacgactggcatcctgccctaccgtcttcacttcaacacgtcggaaccactgacggatctcgagtccaagaccaaagagtacgatgaggaggccttcaagtatcttagctgggcagccttcccacttttgggctgctatgccgtgtactcgctcgtgtatgaggagcacaagtcctggtactcgttcatcgtcagcacgttggtcgggttcgtctacacctttggcttcatcaagatgacgccccagttgtttatcaactacaagctgaagagcgtggcccacatgcccttccgcactatgatgtacaagtcgctgaacacttttatcgacgacctgttctcgttcatcatcaagatgccaatgctgcatcgtctggcctgtctccgtgacgatgtgattttctttatctacttgtaccagcgctacatctaccgtacggatcacacccgtgcgaacgagtttggtcaggtaggcgaggaagccgagactgaggatggcgcctcatcagagaccaaggccctcctagagcactcagagaagtcagagtctaagaaggacaagtagatatgatactgtacttatcacacagagtaaaacatcctttttttttaagtacatgattcttcctacagaactagtatgcgccacccttgcgatacacctgcgtccacttgctgacaatataatcgccaaagttgatgtctccattgagcagtttggaggcgacagagcgggcatcctgagcatcggcagaatggtccttggtgtcgctggctacctcttcctcggaacgctggtctcgtaggagactgtaatttcccgaggcggcttgacccttgaactcttcctgaaccagcaaagggatcttggagtgatagtcagggtagtagaagcagcacatcgagtatcgctcctccaagccattgctgacgacgcgatgcagtgggctgatcaactttcctcctgtgagcagcgacaagtagtcgcctccgttgacaaccagtgtgttgtcgaccgagggcacatcgtgccagctgttgtcgtggaagagctgcagtccgaccgtcttgcaaggcgagagaatgagcgttaggaagccccagtccgtgtgggcgctgttatagtgaaaggggacggatgaaaacaaagtttagaaaaaaaatcataaacaggctgcggtcgcctcctacggggaatgatttttacgcccattcttcgccactggtttacctggagccgatctgagcagcgtggccttggtccgcgtaagggaggtagtggaaaagacgcatgaacgagatggtctcgcttgatgtgcagtactttgccagctcgttctcgggcaaggccaaggcgagcgagataccctggagcaggcccttggccacttgacagacattgaggtaaaactcttggagtgtggacttgaatgcatcccgctggcccttgtccagtcgatccagggtctcttgagagggccatgaattggggccccgaagcttgttgaggctggtctcggccagcttggcctgtaactcggctgagggccattcatatccataggaaaagccctccttgagttccttggtggccgatccggactcgcctccgatggggacgtagcctcgcgtgaagccgccgggcgcgatctttgggatgtgggccttctcggcagcgtcgaatgcgaagaggcgtgaggtggcgtcgaggatctcggcaatcttttgggacgagaagacgggatgggtgggcgaggtgatgtagaagacgccgtaggtggtgaatgcgtcgaggagagcaatagcgacctgctgcctctcggatcccgtggacgcagagtccagcaacggcgagatgtcgatcttgggaatggcaacggtggtcattgtggggagggagggatcagaaggagagcagaacagcgacgtgacaaagggacaaggacttgctttaaaaggctgggctgggtgggaggcgaggcgcgactgtggggggagacgtaaaaaaaaaccccccttgcacagagtgtgcggcccgcaaaagactatttttccgggccacttgagtcaccgagtcgcccaacatgcataaggccgccaacttggcagagcccactgccacctgcggccttagctggtgctacgactgtggtgggtcttgcattcgtcctcatcagggtcctgcctctctgcctctggtgtctgttccacaagcatatcccggtacgtgatgctgactctcctggatcggacaatctcaagcccgtccacatactcgacaagatccttggaaatgccgtgtttgtactcgtagcgacttgcaccgttcatcacgaccagagatcgccgagctgggagggagcgagagagagagagagagtcaccaatgcgcagatattgaaaaagaaggcaaatcctgttaattcgatacaaaatatccttgtaggaacgcaatgcgtactcttcgcgacgattgcttacggaggagaactcgatggatacgatgcggctccttgacatgttgaaaagtcatcacgcacgccgaaaggagtgacactgccgtgatggtcgatccaaacagctttggtgcatccacatgaggcatgatgccttgtccagtctcgtattcgttcacaatgatactgttaggactggccaagtatatcttccgttccagcagccgctgtgtcaaaaagtcgaacatggtgggcagccgctgcatatcgcctacgacacggctatcggtcgttgtataagacaaaggatggtgtatcagcctctctctctctctcgagctcaaccctgtcgtcatccttacgcacagagtatcgatgagttgtacagtgcatggcctggacattaccgcagtcggtagctaaagacaccgccatagtgctgatggcgtcgcttcatttctggattcggctcgatcccctttccagcccaatcgcgcgcatcaagttcctgcatgagcaaggactcttcttcctctgtgacaaagtcatgaaccacctcaagtccttctaagcctgtgaagtcgctcgttgtggagaatcgcatgaggtggtgggatcctgaccagccaaggtactgcagtagcaacaaaaacggggaaagacaaaaaaaaaagaaagaaaaaagacaaagagcagtgccggatttatatttcagtctcagcagtgactattgtggcatgctagatgcgggcgagagagaagcgtccacatcaccgaaggggccaagagcgctgtcttccttctggtgggggttagcggtgaagaggacattcttgagcacctgcgagatcagaccgtgggtcgcctcaacagaaatcttgttgctgtccctagtgatcttgctgagctggctctcttcctgctttttctttttatccttggggaaatgtcccggaacacccatgggtccaaagccgcccggtcctgcacgcgatgccatggtggcagtcatctggagtttctctgctagatccgacatttgccttgcagcgtactcccggttctatcgcacgtacaaatatgcagtgttaaaccacgcatgcgactctcagcgcagaaatgcgcactgacgggcgtgttggatgcttaccgagagcaaaggagactgcgagagagtgttgacccagtacttattccagagctggtccaaaagttgtgtgtcaagtgtggatttgaagtgcgagatctccaatggatagtactgcttgcaatgaactccaaaatcctcaatcttgctcaaagggatagtctggtactcggaaggtccctcatccggcgctttgtatccctacgaattttgagtgggtggacagaacgtaagcaggtgagtttgaagtgcgggaggcagcagactttgaaacagtccaccggtgggttattacctcaggataggtgcggaaagcaccaatttcgaccttgccagcggagatggttctgttgggatcaatctactccacatgtgagaaaaggagcagaaagctgcacgaggtcagtgctgtgtcaaaggttcatttggtgccgagcataactgccagtatgatggcgttggatcttaccaccactgcgacaaaggggtcctggaactgttggttctgcatctgggtattgacgtcgataccagacagccagcagccatatcctggatgcgagtgataccagccgatagcattttcgaggcggccgacctaagtgcatgcacaatcgagaaggcaatttgttttctgtcaatctttgggacagaacttgaagtggcatctttttcatccatgctgatgcgcatccacgaacctccttgatcttggtcatgtactggaccatatattcgtatccttcagcttgtgcgttgaccctggtttctgtgccttcaacaggcagtgcaaacgcgtccatgatgatgattgtgttgccctgaactttgccctgcatcattcccatgacctcgatactgcctcccgaacgagcgtgcataacctatgggcgatacaaaatgggacggtgtttgttaaaagtcccaccatgggccatgcacggttactgtcaacgcacgagacgagttggcggaggcataccatcttgatcaacgcgaccgctgatatcttgatgtccgtgaaatagtgaggactagtgaggagcaagcgtggaagggatatggaggttaaaagcagactcttttttttttttttttttttttgcaagctgcgccaggcaatgtcgcattgcgcgcttgtttagctttgaccaggcctatttagctcagacgacacctactctttcttccatggggactcgttgaggatgcgcttctgctctgcctcgtcaaagtggtagatatggtctagttcggggttgatggacttgatgttgttgatgaactcaaagttcttgcgcgcattgatggcgtccatgacgacgtgcttttctccgcgtgcgtgcgtggcggttgtttgcggagggccttgcttggctctttgtgtgcggtggagtagcctgttcctgctgagggcggagacgggtcgaggggcaggcggcgcgttctgttcccaagcgagcaatccaagagcggggcttgacgacgggaggaaggggatgcgaggtaaagagattgaaaggcaaagcaaagcgcaagcgggccatgacaaaatgcacagtggggcagcagtcactcccccacggccatcagcctgccagcccctgtttatgcgcaaaaaataaagtgcttgtgtctctgccctccccccaccccctccttgtccttggctctttttttcttacttttttttattgacattctcgtcttcgctcctgtcctcgtccatctgcctgcccttgccctcgcagccatcctcctctgtccttcgccatcctcgtcgagtctcgccccacacccgctcttggctgtgcaggaatgaagagcgcaaggacatccgcacttccatcgttgatccccatcgcgctcgctctcgttccctcctcgtctttttccgtcgtctcatcagcgcaggcgccgttcgagtcgcttttcagatgaccccactccctgcccatgctctgtccacgccaccacgacccgtcctggcagcactcgaggctgctgctgcagacttgagggccctggagccagccgcaccggacacgggcgcgcccttgactccacctgccaggacgcagggcgctagtccaacttcggctttgcgttcaaggtccaactctgcgcctgggatggcgcgacatcagacgtctccaaggatcaccattccgagtctgcctcccctcgcgccttcttcatcgaccgcctctgcatcccctcgcaactcgcctcggcactttcagcagcagcaccagcagccgcacgtccacgatacaggatattctccaacacggacgtattcgaactcgcaaggtggctctccatcgtcgcgccacagcgggtctcgccaggtcaatcctgagagtaccccacgtacttccagaacccctcggagagactcgtccctggcttcgccgttgtcagcagtcctccctgctcttccaccgctgatcccggtacgcaccgccgcaacgctagactcgccaccagtagctgctctagcgccctttacaccagcatccgcgacgactataccctcagataccctcgccactgggagcctggatcaagagcatgatcagcgcaccaatattttttttgctcctccgagcgcaacgtcgtcgccggtcatatcaatcatgacatcatcgcagaggtctactgctccactgaatactgcaggaactaaatcagaaccacaagctaggccaaatgctcgccctagtaacgtctcgtgcgggcaggaggtacaaggagaccagagtgctggcgaggatcatgtgaaagcagttcctgagaaagactcgacagcgcccgaaacgaggacgactgcgctgcaggacccatctgatcaggagcagtggccagagccaccacgcgcgtacttggaacgcatcaaggaaactgtgtccaaggcggaactgggcaacctgctgtccaagtattcggaccctttccatcaggccgttcttcgtgtccacatggagtcgtttgactttagacgggatcctatcgatcttgcacttcggtaggctggtgcataccatggtcttgtgattctgcgccttcaagtctgctgagagaaattccaggagacccatcgacattaactctgacctttatccctgtcattagcaagtttcttttggactttcactttcccaaggaagcgcagcagatcgaccgtgttctggaggcctttgccactcgctaccacacctgcaacccacatctctttcgatcctctggtacggcatgtagcaaaaggaaaatactctggtcatggtccagtcttgagtgctcatttgctgatatcgttgcgtttttttccggccatatcacagaggtcgtttacaccattgcgttctcgctgatgcttctccatacggacgcccataacaagaatgtgcgtttcaaaatgtcgaaggagcaatacgtgaagcaagccaaaagtattgacggcgttaatactattccagcagacatattggaggtacgattttttttcgcatttcttttttttacgtctccgctgatactggcgctcaacatgtggctcactattgatattattactttgagtcgtgcaggtgctctatgataacatcacgtatctcaagttcgtatacgcagaagatgagcttgatgttgacggccaaagaatgactgaggtccagccatcttctggctcgtggtttccgaggcgccgcactgcaagcaatcagcgctcggactcttacagcatgattcgacatgtaggtttaggctcaggagcgccaaattgtagtttttctcaccttacttcacgatgcttacggaccattgtcatacggatattattgtagggaagtattgctcagctgacgccggatttgagcgacctgatcccctttcgttggccatactactggaaaggaacgattgaaatggttgataatgtccatatcaacaaccagttcaccagagcaccccttgcgcctataccaggactttgctctaaacgctatagccagcatgcacagctacaagggtctggctcaacaccttgcgtctcaggagcatacgaccctccaggcgtagcaccctatgtctatgaggatccccatcccaaccgtgatcagcaacaggagttttcaggagtagtgggcgagcgagtagagccgccaagaggtcaagtgcgggttgactgcgcagagctgaaaatcgtcaaacagggaatcctcgctcgcaaaattgatatcgaaaatggcaaaaagagcgcagtgagaggctggcgagatctaggcgtcgtcctcagtgggtcgcaacttttgtttttcacggaccttgcgtggttccaacagcaacgcgcctcatttgtagggttcgatcccaacgctcgacccgaggcgagtgaaagctgtatggtggacctaagcggtagtgtactaccgatgcctcaggctttgatctccacacttgattccatcgctgtcgtcgacagcagctatcagaaatacccacatgtgtttcgactggtctgcccgaacggcaagcaatacctttttcgagcagagtcagaatacgatatgaacgactggatggccaaaatcaactacgcctctgcgttcaagactgccggtgtacggctcaggaattatcatgtggcgtgggcaagcgatgttgtgtggatcaaggacgatcaaggtcgacatcaactgaggagacggcaacagaagcctccagccccccagccagagttgcctgacggacgagcagagctggtccaggccaagatcaaggaaattgatcgacaaatcaacatttgttcagcgtcattggcagcagagctgcgtcttgctcgtggactcgaggtgatgatccctcttcaaaactcgactcgtcaaaagattgttcaaagcgcagcggtggttggcaagaggctgcgtcatctaatgctggagaggaccaaactcgattgctttcgcaccattctggagcgcgatctagctgttgttgccgcttgtcaggaacagggactaagcgtttcatttcctggcagtctctctggcaccactgagttcagcccgtcctccgtcagctctaggactcttcgaaccggctcatttgcggacgttcaggatcaagccgaagcggattacgtacaccttcgccatccatcggccccttatcctccaaatctgagtatgcacgatcacttggacaacccgaaggaggagtttgtcttgaactctagccgaaccagtcagagcagcagcagaagcgccaaagcagtatctcgaccgaggttaaacctacccgacttgcagagaactgtctctgagaatgctctgccagaggtcaagcgtatgcagccgccgagagggtccgagcctccaatgggcccaatggcgatccaagcagccattattgacgcagcgcgaggaaatgttggtcctgtcccgagcaccatgtccagtcctgacccgaaccggtatcaagacaaccatctctcccctggtcgtagcccactgcaggagagccatgtcccatcaagctcgtcgttgctctcgcccgaatctccctcggcacgaacgtcgggtcggtcccgtgcattgtctatgccaggtcagcgtcccataatgataccgcggaccgtctctatctactctagtagctctcagacagcgagcagacttcgacggatgctggaacaaggacttgggcacctaaagtggggcaactcgtcctcaggcggctcctcactgcgaagtgagacatcgtttccagtttctgatgacagcattgttcatgttgaggcgagtatggacatgaataccgctacatcctccgacgcagagcagtatccatacagcgaggcaatcggacaggaggacactacaagtcgcggcaatcaccgaaatgcctacggggtgcaggatcaagattatcatcatggccagagtttacctttgaaacggatggagctggcaactgaacgagatggatctgaaacactgcttccagcgttgccgttgaacgaaaccatggaaaggcccagatccttggacacgaccacgccctccgtggattcgtttgtggacgatggcgatgacgacgttgcgattcaccacgagcatcaggcttcctctagctgggagcagtcgtttgtgatgatggtgactacggactatgtgacggatgaggctgacaaagaaggcgaagacagtgcaagcataggtgggattgaagtcgagtctgaggcatccagtgagcacgctggcaacaaagctcctagaatcctgacgacggacctgaatccttcattgccgctggatattccttcgctgtccatcacactagactagcccgaagtggccagcaaaataccaccccgcttttttttttttttttccgctttttttttttttttttttttttttttttaattcctgtggggtgtttgttcgttgtactgatccattcgtaaacgtggaggtccaagcccggtgagaagcactacattgacatgtaccttttgatcgaaagaggaaagatatatcgccgcaatttcgccctacaagtagtttctaatccgcaaaaaaggcgagaaagaataagggctctgagaagaggggcgcaaataaggtgagtttccgtgggcactgcacacgacactggtgcttctgctgcggaggttcgttgttgcacacgtcgcctgtctttgtgtgcgttgctactgctgacactgctgttcaacgagtgttttggtcgctaggagtgcaatgaagtgttggcaaccacattgcatcgtcggaatgagagagtcggtcgtcgctgcttttgcttgcgtggccacctcgcgttggcagaggccaccaacctgcaaagaagagtgagcgtcgcttttcgccgttcgcccgctcatgcatgctctttgttttctttgtttggacgcccacatggtcagacgctcagcagtgattttcattggcgaaacggtggaattcccaggcacttatcggataaagggacagccgatcaagacacaaagtgcaggccgttcattctctgctgctccagccttcacagctcgtccactttgactttctggtcgggctttgggacatcgcgatggcgaagaaaaaaaacgttcgatcctctccgcccccgcctcgctcctgcacgtgctagaccaagggctgggtgagacaagtccgcactcgtctgtcggcgtctccattattggttcgacacactcagtaatgaaggcagtagtcagtcgcagtactgtagcgagtcagaaggccccagttttcgcttgtttaccccgctgtccaaccactttaaatatcccgctgtcttctttctactccccccaccttttcatctcattactacataccatgtgggcagatattcgcgccaagtggattggcatccgctacaaggtacgtctctccacagccgcttgactctcacacacccaacgccgtgtcaagcccatcatcctgcctgcaaccatgctgatccctgctctcctcggttttatccctggcatcaaaaaatacagtacagaaagcccctggctgaattcttggccactgccatcatgatcgccttcggctgtggtgctgttgcccaaaaagtcttttccgaaaacaacacctggttcaccgtcagtcttgcctggggtctcggcctgatcattgcaatccacgtagccggtggtgtgtctgtaagtcatctgttgcctgccgttgtttgttgcatcctcctcgagcgcctgtgctgacgataccgcacggtccgttccttgctgaatgaatagggcgctcacttgaaccctgccgtcaccttcgcgttggccctctttcgtgggttctcctgggccgacgttccaatctactgggtcgcacaaatagcaggtgcctttgtcggtgctcttgttgtctatgtggccaactgctctgcgcttcgtgctgctgatcgtgaaaagacaatgggcatctttttcacggcaccccaaacaaccgccatatcaacagtggatgcgtttgtgtttgagtttattgccacggctctcctcctcatcatcatcctggcgaccacagacaagaaaaatctccccgctggcgttgttcagcctctgacgatgggtctgtccatcacactcattggtaccacctacggctaccagactggctacgccatcaaccctgctcgcgatctgggtcctcgcttcttcacggccatctctggttggggctttggagtcttttcccgtcaggattattacttttgggtccctatcgtggctccatttctcggcgcaaccgctggtgcttgcgtctatgatgtctttatctgctccagcgatccaaaaaccgccgacactgaacatatttgctgagacgaccaagtcgggtgataagttttcctctttacagtatgaagtgaggctctgttttggtcgcacggagcacacaatccatcaatagactaatcgatatcaatgtacaatttgtaaacaaaccaaaaaacgcaatctttcccaggcttgtcattgtgcccagatccacaagattcgatggggagagatgtcgagggtgtgcagtctcattcgccttggactcttctagttcactccgatgaggtcagaatgagcagctgggctgatgcaagtcggcttttgttgcttgcttatgagaccattgcaggtgatcggtatacaatgcgcctcacacgtcgaatctccaccaaaaaaagggcttaccactatatagtctactgtacctgttaaagagtctttctgtcagtttttcctcgggctctctccatgggttgtggcacataaagtccaccactcggcaattacaccagtcctatgtcatctccatttgagtttggttgctgcgaagcgtacctagcccacagtagcgccgggtagtctatatgttctgtacaaccagttcctgtgaccacaggcagcgacgccttgcagaccaagcaggctgccttgaagccgtcagtgatgttcctgttgtcgtcttctcccctgcctgcggtttctgtttagtggtggagcgggaaaatgctgtttcattggcgctcgtcatggattttgccacggcttctcaaggccaacattcttggttggctgctgtccttgagcggggatgaaatgttcaccgatcggctgctgaagagtgcaccacggcacaacttgcctcatcaaacacgccccatcacagctcttgtcaagtccatgaaaaatgcgcccgaaataaacggttcgctgtgtggtgtaacagggttcaaatagagttttgcacgcgttgaggcggaggaacgatgaaaaaaaaaaaaaaaagaaaacgatctccggctaccggaaccagtgccgcgctgcatgcacgagagtagtgctcacatctcaggccgcctcgattgcaagtacatacggtagttcctgaaagaacattcagtctctgattccaagtgatgttgtctgaatgcaaaagcttctaaagtcggctttggcgaactgcaagacgtattattctcgccggaacctatgaaccaaaggaaaggtagtcagtcgatggtgtgatggttgcagtactcttgcgatcatacaactccactcaagagtgtcccctgatggcctgttgtcctgcaaacacttggcgcctacagtactgtactgctgcaaaagcgtacctcaaagcaagtacatttgtgcagacactgctctccgctcaatctcaatctggctacccgcctgggttgaatcgacctccacaagcgtcttttactgtacctcgggcgagaatctcattggcaaacagggctaccccacattgaccatcgcggtgccaatcaaacttagccccaccgtttgcagggtgctacgccgataagcacaacgacgttgcagcctacgcgctctcgaatggcccttgtcttgataaaggacccctagggggattttaacctatgcatccacgacacctagatcactcgatatgagagaaggctgacgcgacgagtcaacacaagagagctaggttgcactgccgtcgatatcgaaaaagagcgatgttatcataccttgttcagctgccgtgcatcccacgctatcgatgcgctcgagggtcgatgatcacttgctgaaggccatggacccttgtctagacatcgaacaaaaaagtgtgcttttttagatacctgatgctttcaggggcgatgcctcctatggttttgtagagtcatactccatcggttgccagcatgatcttttcggttctcacctcgcagatgcccttcacgcaatggttcgtgcgcagagaacattaaataatgcagcgtctcttccaaccccagtcttcagcacctcgcgcgcttctgaagacttgttcacggaggtcacaataatgaacctctactgtagaaggtgcacaaccactgtttctccaccgcccttcattgacagctattgtattagaactgcagcacccgctaccgtagccatgccccagacacagagagggacgtttcaacggacggaacctttttactcatgtcacaggctctcgtcctcccaaggacgttggccagacattcaacaaagccgtctcctggcagactgtcttttacagcactttcacagcagtcttgagcagaggcatcaccacaactttcaaacgcgcgcactcccacttatcatttttttttgtgctccagtcgcatactggtataaagcgcccccaatcccgccagttcttgcatccgcttgacttgcgagctgctccttccccaaaccaccccattcgcgtcttgggttaaccctgccttgacgtcaatctcagaatcacgcatcaagaaagttccccgcacggtttctaccggctacattctgttcccagatctcttgcagtggtctttctttccagacaagccaattccgtccaccttgccaattgaacaagtcctctcttgcggatctgctccttttccacagtccagcttcactctcctctctcttcacccaagcgcaggttattacagcacaattgcaagacacgcagcagtccttttttttttttttcttctctctctcgcttacgttccttcgccacttgcccgataccgctttcgcttacacgttcgccattgcccacacccaccctgattagacacaacatacacgacattgattttccgatctgtcctcctcgttcctgaacctggcgcagcgtagaggctactttcagagtttgcacaagcactgattgcatcgctcacttttgtgtcaagccctacatcttttcctctcgtcgtacatacacaactatagcagagagtgcagaccgtccttgctctcgttgtcaatctcctcagtcttccggagtgctcgcggtggtgtccactcgcgcttctttcttttcgccttttataaaccacaccagcgagcagtccacctccgcacgctctcttgactttttttttcttacccccaaccatcttcacgtctcttcatgccatgtgcacagtgctcgatcagaggtagctcccgtcaatctgttcagggcaacaccccaccgcctttatcgatcaaagacagcgcccctctcatgcgcttttttttttgtttccaccaggggcccaatgcacatacttcctccctggtgctttcagttcctcacttcactcgcttcaagagtcgacaccacccaccactgttcctctcatacctccactacgcttgctgcgtacgaccccattgtcccagctcgcgatgcgttcttgcatttccctcttgcctgccatcttcagaagtaaatcatcacggcctcgtctctttgccttttgctctcccaagccagcaagtcagctcttgagattctagctcgcgctcgtcctaaggagagcaggctacaccttctcctctcactttttgtttctccacacaatcaccaacggacatcgctttcactctcacaccggtcactactcttgtttttggcacacctttcgtctctgcttctcacactcctccgttcaccattttcactgcaataaatgttctttttcaccctacatctttcagtgcagtcgaactcgcatcatctctttcgcagtcaaccttcacccctcacttgcggatgttcacccccttcgtacatcagccgccgttttgatactttcactcctctccttgccgtggacgaccttgaacagaacacaggctacgctcacagcctcttccttcgctattctttttcgacctgtctttacaccactcgatcgcgtcgacagtgaccgacagcgccttcaattccactgactggccgcctctgtttgctcacatcccatcgttttttcttttttgttttgggccacgaacacctcttttgagtctcaagctcacgcgtcgcgtcctatataaccctcgctctgcaactcactctgtcctcttcgtggtgcccgcaccattcaccgctgtccctctaaatttcgtgccagtataaaatgctcattcccaatcagcacagaagatctgctcggccctgctcccgccgccccccacgcctgtatgtgccaaagacaggtccataccgccccgcccatagttgacttttcttcctttactcactcagacctggagtccgttcttgaaagtgtgatttttgctcatcatcgacccgagtcccactcaccagagcgcaagctgcctcgacaacaccctacagtcttctctctctcgccttctttcgttgcttttttctctagtctttaccgttcccacggcgtgttcgcgggtactccatcaccgttgcacccgtcagttgctgtccgacgtaagcctacctccctctgtattttttttcccaccgcacttctctccactctcgcttcacgcacgctttctacttgttttctcaccaactcacccccatcttgaacgacgctccctgacatctccctgcgcaactaatcacctctgccgtcagtgtccctctctgtttctctcagatcgtatcggtggtagtcaaggctcaccacggtcgtaaactctccatcaacctcactcattcctactcttatcgcaccttttcacagtccttattccccttgaacaagcgggtcaaagctttttttcgaaactgtcactcggtcactgtcgccttcacgcattttatcctctttttgtctttccccttcacctctcgtccacccactttcttgggcacctcttccctcgcacttcgcacgccctgttgcgccgcactgtacacgttcgctgcctccacacccctcatccctcacccacttccatcccgagcctatgcagtacaaaaaaaaaagcacaaccgctggctcgtccctccagcacgtcctgctcaacccacccgagccagccctctccacatcttacctgcatttgtcgcctctctctagcccgaccatgaccgtttgttccccacttgatgctgactgaccttttctcaaatctgtctttaaaggacacgtccttttcgaccactgcgagtgaaccagggcgacgagtttgaaaagttgccaaccgtggttgccagctcgttcccgtgtggttgcaagcacttcctgagcttgctggaacgaggtagcgaacacagctagtccaacctttcgactcgacgcactgggaaagcgacaactgttgctatgcgggctcggggaataaaagacaatgaaagagaggcagttagtctttgaacattacagcacaatgagaacatggatcacagctctttgaccggcatccccaccagcactgacagtttgcactcgctttgaccccctctttggcacagttgctgtcgacactcgcatctacgctggctgctgcatcttgtcttctctggacagtgctgatccttggtatagcactcgcctaggcaaccgaccaagaccctcgcttaggcactggcaaactgcgcagacactggcataaacacccacactgcgtcccacagtatgaacaggaagcacttactctgtgaacgtgaagcctggatgcttgccgggagactcttgaaaaacctgggaccggacatccgttgcaggagggttatatgtgaaaagacaagaggagaaggtcgttagatccttgttcagcacacgcagcggacgatctcttgcattcaaaagtgcaatgccgttgctcattagacttaccaagaacaataaagtggcctttttccaaggcggctgtcctcacgtggtgcttcttcatcttgtttgcgcgtcctggatatggagcgagatgaagggacgtgttagcaagtttaaaaacagtgtccctcaacaagcttccgtcatgactttgaccgggtggagtatgcagcgtcaactttaccttgcggttgctgtatcctcgctcggctcatctcatcagtgcggctgcacaataagtaataccgtggctaactatcgaaataggagatagagtagacacgaatacgttagctgctgttcagctgctgttcagctgctgctcggcagtaacaagcttgacagtatagacttttgatggtcttcaaatagttaagcacgcttacggtactcgttcaagtggatcctcgctgcatcctagagtgagagtctctttgcgccccgtgaagcgtcctaagccaggaaaaagcgaagtaaaggttagtaggcgcagacaagaaacatgctacgttggttgcagaatgagcttgtgctcattccgcattcatggtcattcacgagtgctgaagcttccactttttatcttttccgctgcgtgcgactaccgttccgcgagcagaggcctgccagcgaggtgctgggcttacgacagagctgaggacgaaatagaaaaagaagaaaacaagacatagaaccaaagcaaagttaaaaaaagcttcgtcacttgagcgagctgaggcctcacttcagccacaggagtgttagaagctttgaggatcgtggattctaaaggttaagatggctggcggatacaacgagaggggtgaagctttccgtggccgctgacagagtagaaggaggcaggagtggtggtggagcggaaacaagaaaaaaaaagcttcgtcactgagcaagttcaggtgtcacggcgtacggggtgggaggcgaggcaagggaccttgatcggggttgataatgttttattgacggaagagaaaacgatatccgctgaagttgtgcgactctgtgctagtttgctatttatgtggacttgccccgtgacatcaggcctcacttcagttaacggagagtcagaagctttcatgagcgcggattctgaagatgggggtggatggaggataaaaggagagggctggagcttaccttggctgcagaaagaagagaggggggaccagagtggtggtggagcggaagaaaaagaaaaaagagcatgcgaaccggtgtggagtgcttaaaattcgattcctaccagccacaaaaaattggctcgggccacctgcagtgcacagactgctgcagggtactgttacacagacgagtacaaacaaacaaagttgatgaagctggtgaatgaggtcgtgctcatctcaacattgagttcttcaagaaccgcagcacctcgttcgtggtcttattttaccttggttattgttgaggttcgatcggcgccactgctggaggtcgatgtcaggcttgaacgagctcaagaaatgagagactgcactgtctcgagagctcattgcttatctaccgccggagcaagtttgtcatactcggctgtgaggcaacgcgaggtagggcttgaccacgatactgctagaagcacgggaaaaaagcaaaggaagactcaataagcaacgggggacaagttcaacgagcttggctgagtgactttaaactcattccattgcaaggagtgcagcagtttgacccttgcctagtctttaccttgccagctatacgaagccaaagttcgatgagggcgacaacgcgaacaggtggacctgaccctgatcctggtatgactagacaaaaaaaacgagaggcagttcaaacaaagggcagtgaattcgaatggatcatcctcgctgaatgcattcctcgattcgtgaacccaagcgacctagaaaaaacccatcgagcctcggtgtgggacagggaagtgtgttttcaaggtgggttgtattcaagttactaggtaaggaatacaactataagggaagctacggactatatataataaacgatgggattgccgcgtgatgccgctttggcccatgggcgtagatcatgggtctctcgcaaaatgggcgcatgagaacaaggctgtacaaggtagtacagggcatatcctaggactatgaccatcctaggccatctacgcgacactcggcttcagctgctctcactgcttgtggtgagtcgtggtcatcaaaagcttacctcggctgaaccggcgagatggagtgaagataaggaaataacgcgccaaacagtgcgcttcggcgtataaaaattcgactgagacttaacacggtctgatggcagtatgacgcaataatgaagcttgtgagtgcgtcggctgcatgcattcaattatgacctggacggagcgcacctagtgcttatcaacaagttgtacccgacctcgcgcagcgtccaccttggatactcttacccgcatgagcttttgtcgccgataaacgcatccacatctgctatattctcccttatagacagaagagcttaaaaagtaccatttaggacattgtttccatcagctcaagctctccttaggttcaaataccacttgaaagcaaactctctttatttacaagcactccatatgtgcaagggtcctttaagtgcaagcactcttgtccacaagctcctcagatgtgcaagagtctcctaactacaagaccaccattgagctctctctaaatgcaagatatctctaaacgacaaacaatctctaaacgacaagcctctttaactgacaaccctctctatctgatagacctctctaaatgacagccctcgctatctgatagacctctctaaatgtcagccctctctatctgatagacctctccaaatgacagccctctctaggtgacagccctttctaaccaatagccctctccagccgaaagctcactcctaccgattgccctctctaattggatgccctacaaggacactctaaatgtctcagaatctgcggaaaggaaagacaagagataaaaaaaaaaaagatgaagatgaagatgaagatgaagaaaaaaaaactaatttacaacaatctacggcgttgtgatggggccacgtcgtggtgaccccaatcacattggaggcacgcgcgtttcagtttgggccattgctggcccatccacgcgcgctcctccgcgccgatgttgtgccggaggtgtttgagctcaaacacctccagcttcttgaggcgcccgagcctctcaaggtcccccttggcgagcgagaaatcggtgaagccaccgttcctcgctacgccattgtggaggtgcaggaccctgagctcctcgagcgccccaagacggtccatcatggcctcacggcccgcccggttgcacttgccgggtctcaccgacaactgcaactcctgaagagtctcgctgcagacccaaggcctgtcgccgacacttcccggcttcaggaacgtgttgttgaacttgggccctctgctgctgagcgagaccagcgtctcgaggttcatggccgaggcaaggagctcttgtaggtcggagacctccaagcctctggatggcagaacgaggcgttctaatgtgggggcatggctgacgatggccgcgcttgacacgggtccgaacttgggcaccttgatctcgatggacttccaggccattgaatgccgtggctgggcttgaccgtgctggggtgaggtggggggtgtgagagtgcctggcgcagtgggcacggctagagtgggggctggcgtcacgactgcccacggccgcgacgaaatgattgtggctatatcctcgtcgtctactatgtagtcttgaacgtcgatcttgaggtcgtccacgaccggacagagcgcgagcaacatctcggacagtcttgacgcttccaggcgtgaaaagaatgtgcctttgacagacagtgattttaggtcctggcaccgatgaaaaatgcgttgtgccaccgttgaaccgatgcggaggaggccggcgtggatagtgagcttcttgagggtgttacgagggccttgtggttcaaatagcggctcggtctctgctgagtcgtcgtgactgaggcgcatgtcgatcgtgaggtcttcgatactggctgggagcccatcaatgagacgtgcgagcgttgcggaatgtatgtttgctcccttgaagcttcgaatgcggagttttttgagatatttaaggccttgaaggcaggtgtcgatattgggcacgttgacgacggtcaggtccatgtcaagggtttcgaggaagggacagttgcggagaaaatggatgatggtaacgtcccattcggcgcagtagtcgctgaggcagctgacggcccagggatcctcatcgtcgtactgatagttaggaccctgccaacggagctgaagtgaacggatattggttggctggtctttgcagcactggctgatgagcttcaggaccctgtgagagccaatggagatggaccgaagtctctctcggtgacgggcagttgcatcgcctgcaccgcgtcggaggaagagcgtttcttgttgcggcgtggagatcttgaggtcggaccagatgtaaggtgtaaatagagtgttcaattcgcgactcagctgagcgcaggccacgatggccgagggagagcagaaggaggcgatgacattgaccagctcgggtatgtgcagcaccctgttcgccgcattgagatcgaactgggccgatgtggcgcgtctcttctgcagactggcgaaggacggcgacgagggcggcactgagggcggcaacgacggagccaatggcgaggacatggtgtgaaacgagcttgagggggtgtgacggacttgcgaggcttgggaggcttgggacaggaggtggaggcaagcaaggacaggcaaggcagctgaatgtgcaacgggacgcagttgagcagtcgatcgtggaaagagaatgcgacagtggagcaatggagaggagcacgagcagtaggagcacgataagcaatggctgcatgcagtatgagcaaggtgctgtgaagtgaagaagaaaagagaaaagtgaagggaaatcgacactccttttatagcttttttggacacagacaacacaacaacgcaacacacaacagatcaacacaacacacaaccctcaacacaacacgctggtgcttgcatgtgaacttttttttttttttgctttactgtactttctatcgccattgaggaagaccatttcgaatgttcagtagtagttgtatcgggcttgcatgtcctgcagaatgtcgttgagctttagggcgccatgtccacataagcaagggggtagaggaaaggagagtaaacaatgcgatgagaagggaaaaggaacacggccatcggtgttagtgcattttcactcgagccaacatcgttgaccaccgctgcggcgcttgggtgagcccacacgcactctctcgtccttaccttccctgctcccgtttggacagcgttcttgagggtggtcaggtctgcctgtcctaacttcttggcgagctccgagcccgacaggttgctcagcgacgatagggacacttgcaacgcacacaaacacatatgcacacgggccagaatggcatgagaaagagagagagagttagtgtgtttgttcaccctgaaagaagcattgaaggtcattcccgccaatcaccacaccgagataaataagcatcggccaatcaggtcgtaccatcactggccaaggtgggcgactcctcaggtcgaccaaagtactggttgctgctgatgctggtcgcgcccgagaacgtctgcaggcggctggaggcctcggcttgcgcatccgagtcatactggttccgtccaaagtactgatctgacgatatcgccttttggttgccgaacttttcccgcgccgatgttacgttttctgttcgaaggcgcaaaaaaaaaaaaaaaaggagggggggtggggtcagtgaacattatcatgcatacaagattagacaacaagcgctagcgtgagcgggtgtgacaatcaccttctacttgaggtgaatatccacctcccatgcccccgaaacccatgcgtgcactcgaaggcttggaggtgggggcggctccaaagcccatgcgacccattcccattcccaaacgctcaacatcctctgaagacaccctagacttgtctgcagcgttcgcctgataatagttggtgcgagcacctgtggggggtgcctctccattctgggctgctttcgctgcctcggccttggccttctctgcagcaagcttttgcagtcgctcctcctctgctgcctcaaagccaagcttctcgatcctctcggcctcggccttggccctggcctcggcttcctcaaagctcagcgttccagccttctttgcacccagcttcattggttttgtcgccgtgcccgtctttcgagcagacgtcagagtggatttcacaggacgggaggcagcggttgaggacatgcgattcgcggttgatgatcctagtcctactacaggcggcccagccgtagagggcgaggttgcagagttggtgggggatgccttcttgggttgattccaggtattgaagaaatcgtcgtctgctgcagccgctggagtggagactcccgaattgatgctgttacctgcatcctccgtgtgcgcttcgagaccatgtttaccagggtggctgatagttattgtttatcaatgggcgatagagtagtagttgtgaagaaaaaagagttgatttgcatgatcagttaggtgaacattgttacagagttgccatgttatgatcgacattgagaaagagcatcgtggcagttgcgggccaagcctatatgaagacggtgagcaaggtcaacttacgcaagcatgtcctccttgactctttgggccagtctctccttgtacgtgatgccgatcttgctggagtactttgtctttgcatccttgctgtctgagcctgggaacttgttgaagtattcccttgcagctgcattcccacccagagtcatggcgcgcagctgctcccaagtccatttgtcaagtaccgtcgatctaagaaatgtgcaagaaacagatcagaggctgaacacaaacgaaagggttttctttcattcatgcaacacaaagagcgagagactgacgcatgtccatccgtcccctccccctgcgctttcctctgttcctctgggtgcaaaacctaaataaggaggtccgcgcttcatccagtgcagttgagtggtgtgggaaaactttatcacccggagagaacactccacatctcagccagcataatcgcccaccagctccacgctccttggatgaccagctttgttgcccgactctttgcatcctgcttatctcgctaatcagtcctatggcacctccactacgtttgcttgcatcaagagcaaggggggccaatctccatgagagccagactccaaaaaaaaaaaaaaaaaaaaaaaaatcgagaccaaggacacagcgccacgtttgaagggagcctgaacacctcacttggcacacgtctccaggtctgatcgctgacacaaaagagtgtttcctgaaagagttccttaccgcacaaagctgacatgggtaccaaagctccggtggagtgctccgcagtctgtgcacagaaagatgccgaatgggatgcttgtccaacagttgttgtcgatgctcgcatggcagtcgaagcagttctaggaggcatgcgcgtttttttttttttttttttttttttttttcaatgttagaacacggtcagattcttttgttactcttcagaacccccaacaacgccgaatgccccctttcggttttctccttctggtcctggtggagctgagtgtacattcccttgcaagctggtcaaaagcaccacctccacatgtccggagcaaggtccctgcttgcccatcttccaagggctcatattcgtgactcgtctaaggggcgaagcagagcctaccctggccagggaagggcacaaaactcgagaacggtgctgacgggtgcaaagaacaatgtaccttgtttgcgcgatgcagcgacagcttcttgaacacgtcctgaatctcctgcttggttggctctgccatgtgtgaagtgtgaatggagagtggggcggtgagacggtggctatcgttcttgctgtcgagagaaagaaggggaaacaaaggagtatcaagagcagcacgaaagagagaaataaaaaagggttgtgcttgtggtgcttgttgtgccgggtggtgtttgcgtggaaaaaggaggcggtcgggtctgtcgggtcgcaaggactggaggaaaagggagtgtgctgcgtgcttttgctgaagtgtgctttttcgctttggaaccgagcaaaaagcatggccacatccaacgccatcgaacatcacgtgtgcaacgcgctttttttttttattacatacatttgtcttcaagatggtgacgagaaagcactgcgactcactccgagtccactttctccctttttagatatcgtacaggccttgctcatacgtgcgcgcaatgcccttctggaagggatacagccgcatgcggacgtagaaccgccagacgacaaagtacatgtacaggttcaacacatagtcgaccaccaggccggcaataaagaacatgatgaacgtatcgatattggtgttgcagtagaacgccgccgccgtgccctgaggtgagtatcccttgtcgttgaccgcgccccaacattcagccgcgatgtggtccttattcctctcgagctggaaggccatcactccgatcctggcagtccccaagaacgcgacgagccattgcacaaacacaaacatccttgtgagcatatatgaccactagtgaagggaatacgacgttaaaaacgagttagatgttgcatcctgaatatggggtttgcatggcctaggtcgcgcttggtcccagggaggtaaatatttcgatgtacgtacgttgcagaggccgaggaaagctacacctgcagtgaccgcttgtaaagccgagaaacctccaaagatgaccgccatggtcgaggagaaaaagtacgagccccagaggaagaggagaataccgccaatggcgttgagtgcgatgaccaggcctgcgaggaacatggcccctcctcggacaggaaagcatagacagcagttgttgcaccacattatggctgatattcctgcgtgcgactaggaattatgaggttatctgaagggtcacctcttcaaacgctatgaagagtgctgcgagagagtggtgacggacactgatttttgtcgttgcaaaaaaaagaagctgcaaggttgtcggcaattacttttgtctaaacactgcgtgaggtgggcagagtatgtgagctggagcgaatgttgtggatagcgactactgatgtctgagcagaggatttaaaaaggattctgcaagctgctatggaggaatacagatagtcggatagtttgcccgtgagattgaggaggtgtgcttgggtgatggaggaaagagacaggaaatcgtgaaaaaaaagccctcaagcacggtgggggcaaaaaatcatgaagcacaacaaagtgcctagggaggaagttggggagaaaggaaaggagatgaaaacaaagaaaagagacaaagagacgaaaaagaggagaccagggtagccaagagtaagtacctgcacatgtacagggaaaatagggctggctggtggggaagagaggggttggggagggggtgtgaggatcagccaacacgaggaggaatgactgtggcactcgtaagagccaacaacaacacgttgacacctcacgactcaatagtatggatcattaggcgtgcagcgcccaaggagacagcagttgactatccgatgtgaccaacgatggtaattataaaaacgatcttaaggcccaccgccagctctctgtgatgatcatccgctcagggaagatgcgagaacgataattccgcccgctcatgagagtggaggtcagccagcttgctggatgttgcgtatcctttgcattgtagacttgcttactccgatcgagagaccaaggcaatgtttgtttagctagtttaaagtgcacttgacccgcgggcgatatcagaggaaaaaaacaaacggcggtgaaaaaggggcacagaccaggtgatggcacgcatgatttttcagcagcgacaggtaggacagaaactttatgttgttgtgcccacgacccctatttctctgtcccaatgacccaactgcatcattgctgtgaatcggtacctgatccactgacagcgttccccaccgataaaagggactgaaaaaagagaaagaaggcgaaaataacaaaagcccaattctctttgctttcaagacttggcgagaggtcagctttggcagtgaaattctatgctcataatacctcagccaggaacggaaatggctgagtccgcgctttttgaccatagccactgatgaagacaaagtcaatggactggaggcggccatgatcgtagtttaaaagcgtgtaggtcacaccttgcttcagctcgctccctgtccttcagtcttggcttaggctgcttttaatcgacgtaaaaaaacaaaaaaaacgtggggtatcacactgaactcaaaactatcgaaggccatcctcctcgttaccacgtcttgatatacgacaacaagcaaacggacactgcgcaggtgccgttactttatccgggaccgtagacgcgttccatgtacgccatccagtgaacacacaccctccggatctgctcccaagcctggtcgaattgttgcttgtcgttcaatccacgctggtgggggaccttgaaccattcacgatgggcggtcttgcagctgcaaacatgatccttgtcgtggaatggcttgagctcgatatggatcaatcgctccacgcggtgtgagtaccggcatcgaagacccgtgatctcattgtccgccgcggtcttggctgcagtctcggagagatcactttcactcttgggggcgagcgacccttgctccgggaaaacctcgatcaagatgggaggagaaccgcacttgtcagaccattcgttcatgcgccgatggacattatccgtgcggccgaccttgaatagggtgtgggtgggtgtagtgcgagctatagcaaaacaggagagataaaaaagtagttgagcgagagaagtcagcaaccactgtgacggcgaggaatcaaggacaacgagaggatgtcaacgctgtggacatacattccagcagctggtagctgtaaatataaccaggcttatccgtctcggagaccgacctctccatggcctttctcagcttgttctgcacgtaatccggcaagttgggattgacccagactaaagatgaaaacgctgttgggttagatccagcgcagtgaggataaaaacgaaggatttcacgacagtcgtgcttaccagaaacgtccagccattgaaggagcacacctccctgaccttcaatatgaacgacgacctcgtcatcctcattgacctcatggtcgtggcacatcaaaacttcacccttctccataggtcgatccagtttaactctgcgcttgcacctgaagccgtttgtattgaatccatgacactggttggggaactcgtcatcgtccgacttgacagtaagatcctcaatattctgtgtgatctcatccacgctgtcctgggactccttgcgccctgctttggtcggcttcgccactgtcgtgggggtcttgctgtctgcaggcacctctggcagaggcttattggtcttgtaagacgatcccagatcggattcagacgattttttcatgcggtggaagaatgaacccacatcgtggacaaatttcctcatagccgcacgtttcgagtccggatccaaatcctcgttggcaaagaggtagctgtggactcgtccatggtacttgaactttccggactccttcctctcaggagccggatggcccgcaggaacgaccgccgtcgagctactggatttgctagcgcttccttccatcttcagtttctccctgacaacctccaggatcttgatagtcgcctcggggatcttgacaggtcgcggtgcagggacccagaatccacccgtgggacgtcctgaggcagagctggactttgtcttgttcttgggtggcgccaggaccgcgttcgtgttgaagatcttggactttgtgcgctggatcttggtcttgagtggatcggcggccgagtcgtccttggttttgggcggtcgaggaggaagcgtggggtcgtcaggcttgatcttgactgaggccagctttcctgtcaggtcgctgaggtcttcgtcctcctccgagtcgtcatccgagtcgtcgctcgagtgttcgtacgagtctgcagagtcgctaggttcatagagttcgtccgactctacctcaaactcgtccgaggactcgaccagcttcttgcgattggctgtcgaccttttgggcgtctttcgggtcgcaggcgccttcttctttggttgcttgacgactgcgggctctgtcgacgcgacatcatccgctttggcgcttttgacaatacctacagcctccaatgctctcgtggtcttggagggcttgctagcggcagcagcgtcgtcggtagacttggaggctgtctttttggggatgattgccttcttggtggaggaatcgtctcctgaatccgtaaagttggatcctgcggatgcgcgtctggcagtccacaggccgccggcctgttccttgtgcttttcggaacagtatccgttgagtttgcccttgcgactgcaacgctggccggttgagatggcaatggccttgcactgctcagcgtctgcccctgggctgggagaggttgaattggtcatcaggaatgagcgtggaggagagaaggattggtatccgacagccctgtgctatcacgagagcagatgcgggatgaggacaagctggaatgcaaaaagaacgccgacagaagaaggcgcgtttacaggagcgcgttctgcggcgaggggaaaagtagagaaagcgagagaggagacgaaggagggtgtgagatgctggtttgcactgttgggatgatgtggcaatgaggcgcgagacggaatcagcgacagtgggtgctcgagactcggctcgactcgactctcagctgggacttgacacccctacagccaatgttcggtgttggctatgcggtccgggaccatggactcaattttttcacttgtaactgctctcactaatttgggtcggctgggaagggcaggccaggcaatcagtgccctcgctccctcccgcgggacgagagtttcaaactgttcttgacagagaacaaacgataaaaggcgttagcccggggcgggagattgacactgccttactgctcccctcgtcaacgagacattggtcgtcctatcctcaagagctgcagtctttgcaagatgatactgaagcacactgtagacggtgacaggacagagcagccgttatggaccctgcagcgaccaccctacagactgcatgaatgcggtacaggacgccaaaaaaaaaaaaaagaaaccgaacgtaaaactcaggcacaagcggaagttttacttttcaagcaccgcatcggattattggctgctgatccacaacattactcgctggacatccgatcctcaccatgtgccttataaaactacacgtaggtcgcgctacagcccatgccatgagcaccagcaaaccatgttcagaaagatataagaggcaggtgcaattttattattcagcttattcaggtaggggtgatataatatgctattattctgtcgcgagagtcttgtactcatgcatcttgatattgttggacattttcgatttcagccatttaggcgtcagtttggacgatgttatgaacaaacaatgccgcgcccgccgactcttgctacatgccatgatcacagcaccgctggcgatgatgccaaggacgacaagagcaccgatccaccagtaaaactctaggccccagctcatgaacgcccacttgcggaacgcacatgtctgatcgtacccaatggtttttcccgcatcgtacgtataaacgccctcggccatgtcgtgcgccagtttacaaacaccacagcgagcgccgtaatcatctggtccccaaacgcccggcttgacgtcgtacgtttccaaaagcttgggactaagtactgactcgatggttgtgtttgaatctatagccttgtagtccagataggtcaagtaagtgtcgtcgttctcgtccagctgatgtatgcggatggcgagttgttcgggtgttgaaaattcgtccaaacgaatggtggagtggttggtgggtataaagcgcgagtagtccttgggcccgtcaagaatgggcacgacgcccacagagtaaggtcgctctattttttccgtgacataatcgttgcaattcgtgttttcgatgctgaggtagaatttgtatcgtccaacgacctcacggtccgtaaactgttgtccgtctatgtgataggcaagaaaaggacgtgcttaatcactgcagtgcagtaggtcattggaaatgctgcagatacagacgagacggtgttgtcagcccctttctttacctgggtgagtaggccaatccttgtttttcatgcaatggccatagatatcgacgtcaatgtactttagcagctgcttgacataaaaatggcgtgcgttctctgaggtgcagctgctgacgatccaggcaatgggcgccagctcctttcgaaattggttcttttcctggatggtgtacatgggtttggcgagaatgttttggataaacgaccccggccctcggcccgcaaggaagtacgactgcacaaagtcagcggtcccgaacgagtaggaccagaggtgcgtaaagatccctgtccactttgacttgatctgccagtcccatggtgcctcgacttttttttttttttttggcgttatcccagagacgcaaggatcgagatggaaaaaatcggtgggcaaattgagaccggtattggaaatgaactcataagtcagcggtggatttgtcaaggaagggccatctgatccagacggggtggaactacttacgggtgttgagtaccagggctttgcgtcccgactggacatcctcgatgctggggaagtcgttggggtcgaagctgctggcgtggatgacaatgacctttgcgtcgtcgtatttggaccgatcgagggtgaaccggcaggtgtagggcaggccacagtagtcgacgaccttgccctcctcgatggtctgtctgaaccaccgtgtccaccacaggatggggtactcctttgcgtctccttgctgctggttgtcctgcggtgcttcagccatggtgggattcggggtgtgcgaatgcggattgagaatgaaaagatgcaacagcaaagcccaccactagggttttttttaaaagtcacctctgtacgtgaggtggacgtacgggtatttcaatacgcggctgttgggggtcgaacggctaaacttctacgaggtcgccattatcaatgctaacggatgcaaaatcaaggaggaggcaggatgtgcatacacagcttcgtcagatacaacagccttggaacgataaggtggcagagagccatttccccagcgtcatctcacagcgtgccttgcatgatccactgcatatggtgtattcagtccttgattgttcatatctgtccagacccaacagtgacctccaatgcacgcagcgcctcaagtgcccgtgcggccacaacctgcggtattcccaccgcctcgaccttcactcccagctcgtctgatcccagaggctccaatacatcgagctggctgtgtagcaaagacggtggcatgtaatggccttgtcgatgcgtcacccggtccgtcaaaatctcctcactcgcaaccaaatggacaaatcggaccgacgggtgtccctcgcggatcaagtccctgtacacgcgcttgagggccgagcaagtgacgaccgcaccacgacctgcactctcttggatcccgatccattcagacacgcggcggagccagggccagcgatcgtcgtcgtccagcggatgaccggaggccatctttgcaacgttggctactggatgcagctcgtcgccttcttggaagacccaatgggtgtctgtgacgagtgcctgggcgaccgaggtcttgccgaccccggacacacccatgacgacgagtgtgagggcgggcaaaggactggttgtgatagacatgctggcaggctactattgaaaaaaaaaaggatctagttgagattggcgccaggagggcgtgctggtgtagactgaggttgtgcagggtgagggcacacgggtgttgacgaagcgatgcagaatggagatgtcgatggtgatcaggagcgaggatgaagggcgatgccacctggaagctggaacgcaggacacggactggccttatcggcgtctcaattggtgtccagggcacttgtccctccacatgtactgtttacagtacatacagcctgacacttcgttcctacccctcctctccacctgcagtagtcgactgctcactcgcttccgcactctcgcacttgcactctcacacgctccctcgcccaaccgcagccttgtctctcagcatgcagctcattcctccattaaacccgcagtggagctgctggccaaggagtgcacgcaaatgctccttctcgctcgaaccaccgtccctgtcggatgccattcgactgcggtgcccacgttcatcaacgtcagcaagatcaccagccagagctcattggggtacagccgacagcgataaggtctcgttctcgccagagggctagctgctggtatcaataagctgggcacacactattcacgcctgctcagcagacagaaagagtcagagagctagaggaaaccccaccagccacactatccagtccgtcaccacaggcggatacgatctgtagctacctcagtctacgaactcgcgctcaacaccctggcggacagtgatgtggagtctaccatgacagcaatcacaaactacaacattaacgatcaaggagacgctgcataccatgagatcatcatacaccatcgtcgaagaagagatcttgaaggagcaagagtatgcctcagaggtgcaaataaccaagttcgtcccactcgataagacagcggctgcagctggcgagagcggggacgcagacgatgcgacggagcacgatccacaggactctgccgacggcgacgacgacgacgaggtgtatcaattctctgaagagtataatatgagagatatcgaaggcaatggcagtgcttcggcaacttctgtcgcatcgagtgtgggaaagcggctcctcgtcttcgatccgatgcgatgaagcagaggcagaccaacggaatgacaaccgggacaagggcgatcttgtatgcgaggagtattgaggagcaagaaaaatggtgagcagaaagctgagagagagagtctgccacggttggcgtcgagcgaaacgggtaccggtagtctaggcccaatcgttagaaatcgctcgaatcttgctctggttttgcattcgctctgcacatgggttgttatatatctcgaaaggcacaagcatatatcgaattgcaaaatggcagtgggtagacgtgtctatacgcgtcaagaggcgtaggtaggccgaattgtctagatatttaatccgatcagaactccagcaacggccatcgtcatttgcccgggggagggggggaggtccgtggccaaataacgttgggtcgcaaaaaaaaaaacaccgccatgaccggagacggtgcggatgacctgttctgcggggggtgacgatgatgagcagagcgacagagtggtatctccgcgtgtgcgtgctccagcagctcctcactttgcagatcaggaaagatacacagtaaaggtacaggtaccgaactaccctgcgtgaacggcgagcgatctgaaaccgtcgtgatccgctgcatgctacgaccaaatactgcaccagtcaagttcgccgtcaaagtaagatgtccacttgcgatcagaacctcggcacacggcataaagtgaactttgcactttcattatctctcctcacctgtacaaacactcacctcattttccaacgtctttcagagaattctttttattcattttctgccgctagtgctacgcttctccaaagagcttcacgttggcactctttggcaaaggaagggcagtgccaaagataaagtccatagagtacggctcgttgacaaactgaaaggtacccttcttcttggcctcgctttccgcccgtctgtcgcggagcggccacgaaatgttgtactttttccaaatccgccgaagtcgcctcacatcccactcgtcatcactctcactgctgtcagactgcaaagccatccctgcctccggttccggctggtctgccatctgatcctcctcgacttgatccatttcaaggtccggcgtcgtggcagctcgcacggagggtggactgtgcgtgacacgagatctaccctgcctcgtatcccgtgctcgagacgctgaaagggaggaggatgctggcggtgccctgcgtggccttttcctcgacaacaaagacgtgccatccgagccatccgagtcgctcgagccctccccagttgtcgattcatggccattcacagccttttgtggcgttggatccccatcctcgtcattatttctagatcctcttgtaaggatcctccttctcggcgctgccgccggtgttcgttttggtgccagtgttggtgttacctgccgagtgctcctccgtgtcctgagcactctctgcggcattggagaagggcttgctgggtgttctgatcgaagtctcatggaagccctggtgcgctttgagggactgtccaatactgcagggtcgtgtcgctccatggaacgtctgtcagctaatcgagtatgtctcgacgggccgtcgtcatccgctccctcacgatgttctgatttctgtctggaggatctcgtgcgccttgctggactatcgatgcccaaagcatcgcgctgtttctctaacctatttgatgtccgccccgtgcgtgccctggtcatcatccgtgttggtcgcccatactcggcatcctcctcttcagttatgtccgagctctgaccatccgagctgtcgctttcggaactgtcgctatgagagttacggctgccatcatcaggttcatcgggagcactgtattctgcatcatctaggtctttcgacaacgatgcttggcgattcctgacatccctgttccttacgcttgtcgacgtcggaatgctcacaaatgccagggattgtgatcctgcaggggattctgtgggactgtttgagtgttctgactcttcataacggctgggtaccgcgatctccacgatgggttcaggagtacgctggcgtctggataaacgccttcccttaaccgccacatctcttccatttccgctgctttgaccttttcgtgccgctgtcacctctggtatattgactcccgtattttctggcgtagaggcggactgaactctggatgttctcgtgctattcctccctcctgaaagagtctcattgtcgttgttggcgcgttcactggtacctcgatctttatcgagactgaaaagcgttcccgttactggaggtgactcggacctctgagaaatggcctgggtgacaggtgcgtcatcgctggcgtcgtactcgagcgtgaccatcgagcctggcccgggtccggattcaaacggcgattctgacccattcgacgacctcacagattgaagggaagggtgccacacctcctgctcatccgagtcctcgccactcgagggtggtgactgctccttgctgacaccagcagctacagctgtctgttcctcgacgctatgatggctcacggatccaagatcaagcgctggcgaccctgcctttaagttgatcggtgttgctggtgaggctagtgatgactccgaggctgatgggggtggtgaaggcgtgccttgcgacttttgatacgactcaaactcgtcaaaatccaactcttgcgtttgctcacgaaggtcaaggtccagctcttgcgtttgctcaaacatatcaaagtgatcatcctgttgctcagaagagactgacgaggtatcagaggtcgatttcggtgcggtgacgggctgcgactctggtatcctttggccgcactcaatttctgaatacatagcttgttcttctgagttggtcacctccactgatgcagaaggctctggtaggggtaaggttggtgagtcgtcgctttcgtcttcgcccgattcatatgcttcctgcaccggtgaaagaacagagtctgctgctcttgtggatgaaattgtggtctcggtttcctgtgatgagacgagctctgtcgattcttgtggtgatgcctgcgtctgtgtcctcgtctgtacttctaccaccacgtgttgttcgctgaccttggacgacaccatctcccgggtagatgtggtacctaagtgagtcggcgattgtgtttgcttctgatcatcatgcttgttgtcactgtgatcagcgtccatcatcaatggagattgctgagagaggcgtgtcgcagtgtgtgttgtgggcgtgcgtttgaggtttgttggctgaggggtcccgatcttgtcatggagcgtactcgtcacgggccgatgcttcttctttctgtgcctgtacttcttcttgatcgagtcgccctgttggctgcccgacggtgaactcagctgcgacatggaggcggatgtcgaaggcgaaggtgaacttgaaatgtcgccgagttgcgacaggctctgggatccgagccgggttgagagcggcgcgagcatgctaccaagcgtcctttcctgcccttgcccttgcccctgctcctgtgtaggcctctgctgattctgcttatgcttaggtgggtggcgattcgtgtgcgctggagcgagtgccactggtgattgggcttgctgtgagagcgccattctcctggctgcattcccacgcacagctgctggtgtgggctggctggacgaggtgggccgcagcgcgtccttgagttctgcggttgtgtagcggacacgcgccacgtcgtccgaggctggatcctggcctagtggtggcaacagagcacatgggcattagtttttcagaagcaggagcaccaggctgtattcaagcgatggcagcacgctgggctgttcgtactgctggatggcgcgccctctggcgtcttgaacatctggcctattgcgcggcggacgagcgggatcatcgggcaccgatggatgctgcgttgtggtggtgtgtgtgtgcagtgcggcgactggcgacgcgtggtggcgaacagaagaggaaaaagcaaaaagagtcgtgtggaccgttttttttttaggtgtcaaaaaaggtaaatcacatgtcggctcatcctctataggttgtcagcctccataaacgaccgcacctccgcgcacagccgcaggcctccgtcctcctcgtccgctgcctcgtccgcgtcctgcagcgcaacttcctccagcgccaagtagacagagtcgccgtgtcctgcactcgccatgcccttcatcacctccgccgcctcagcgcgcacatcccagtgcagcgtcccgtaccggtccagcatcatgtctcttgccagcaagagcatcggccacacctcccgcaccggtatccgcaccctccgcacaatcttgctcaagctggccagcgtggtcatctgcagccgatgctcccgcgtaaacaccttggtcgacgctgcccgccgcccctgcgatcgcatcggctgacttgcgcgtcctcccagtcgttggctaccagtgatggcttgaaccggcgtccgccgatgacctcgatcagctgtggccggcttttgtgtccaagaccgcagagccttgaggatgaatggccaaatatcgtccatgagatgccttgaaaggaaatcgctgcagttctctgctagcacggtgacgacctcaatagccctcaagctgacataaaacaactccgtagagttggagcgcctcatcaagacccgagagaccatggcaggccagaatgcatggatggcggggttcaactctaggggtcgatgccgcaggacaacaatagaccgctgtatcatctccagtgccagaatccgcatgcggggcgattcagacgtcaagaagtaacccgccttttccagtatccggaagcacaattgttcatgcttggtaggaggttccggctccggatgctttggaggaggcttgggtatcgcgtcacgcagttcatctagggacatggattcttcatcggcgacttccttcatcatttcttccatgagatcctcggccgtttctgctggcgtgtccccggtcaaaatcgactggtccttttcagcgtccttggtgagctgcaagaaatagtcgcgaatttggtccggcgtcatatttttcatctcttcctccatcgcatccgcctccgcctggctggtcccgctcaactcctgtaccataatacggtatctctttgcaaactcggccacctcgacagaggctttggcagagtgagaaaacttcatgccaggcgccatcatcaagataccagagtctcgcttcgacgctgtagctgcagctgcagctgcattgctttcctgatccgctttcgatgacgcgtcggatgcttcgatagccaaagccatgacgtggactatctcgcgcagcgccatcaacaagccctctgcgacctcatcctcctggctcttccagtggtcgagcgcttcaaagatctcggtcacagaatcctccaacatggcaatggccggtggtcccaccacgcggatgagcgcacaaaggacctgtggcgtcttggggttggtgcccaaaaacacgatccgctgagagacctgctggatcacatagtcatagttggcctggatgagatccccaatcgactcgaactgacacacaaacgccacgtgttccaaacaggcctcggcagtgtccctaaccagtgccgagtcttgatctccaagatgctccaacaaggtgtagagtgtcctgtacagctccatctcaaaatcgtcactgcccaaaatcaccgcaatcgaggcaacgccctccagtaaaaggcattgcagcatcacgtccgtgctgtggtcgtatatcatcgtctctgcaccgacatcctggtcaaacagttcctcgtcgtcagcgccaaacatcttcgccagcatagccttcttggtccgagaggtctttgctgcatcgagggatggatccgagcgctgctcggctgcctgtcttgaccgtgcctccaacgccatttgtgagcacacctgcaggacctccagatactcctccagcactcccttggcagctctctttgcatgtcgcaattgttttcttacagacgacagcttcttcttggtggactgctccgtgaccataacgttgccaaaactcgccagtccaactccatgcgctccaagcagcacttggttcaatagcagcaccgatgcgatcgttcgtgcatcaaaccatccctgttcctcgcgcacactctggcagtcctgacgcaggcgattggtcaattcctccgtccacacattgatctcagtcgtcgatccaagttgccggagaagtcccataaacgctgtcgaagtcgcctgctcccgcaagtaaaggtggatcctgcgcggaaatccaaactttcgccccgagcccttgcgtgattgcacccatgagcgccatcggtcgacatcgcccgtggccgtagcaagatcttgtgcgccccaagtccctccgtcgccgataacgcctcctccccgctcgtccatattgtgctggtccaattgctcgatcgtcaggagattgatccaaggttggatgtagcccacaagcgtctggtggttgatcatgtgttccatgtgcttgcccaagaacaagaccattccttgtatctgccgcacagagttctgcttcagtgcctcatccacgccatgaagaacacgtggcaacgccatcaatcgctcgcgcaggatttccttggcatagttgatcagatcccttgactcgtattcctccgtcagttgcctcaggtactctcttgctggttgagaaacgtccttgtaatcgtccaaggtgcaacctacgagggtttcgagcaagaaccctgtcacgcctgtggtgttcgatcctccacctccgagtaacttgatcgaagtccggcactccttcaagatgttgaatgccatatcgccaaacttgagccggaccatccagtgagcatgggttcgaagaggcgaaatatccttgaagtgcaaccgcaggcccttgcccatggccgccaaccatgcgtccgttccataatccatattcgtcctctcggggggtgatgatgataatgatgatgccaatgatgatgctcttttggaggtgttgtacatgttcatgagatcctctgccaggccctcgccgttcggcttaagatgaattgtggtgggggcgagacccttgaggctgcgtacgaccatgaatgtccaaatgtccaacatctttgtcaaaacaatgtgatgctccttcagtcctcgctcctttgctgctgcagccagcctgaagatcaatcctggaaaattgttgccgatccccgccgatgttccgacacattgtagcagtttcatgagtccatccagtgcagccacccgcaaagcgaccaactgcgcattcttgaccgtatccggcaagatgcacaacatcgaggcaaacgtctctcggctctgtcgatccggtcccaagagatgatcgcgcacccactgatcgctttttgtccgccatcgtacgagatccgaagacggagcgtgcgacgtgtcggttacggccatgacgtcattctgctgcgccagatcgtggatgccaagggcgtcctcgtcgagtggaatggcatggatcaggcactgtactgccagcagacgggtttcgtccaccatcctgtcctttggggtcgtggtcggatccacgttttggggcgtggccgttgcactggcgggtttgttggcgggttcgtatccgaggaccatgcggagcaggacattgaacaacatcagatccgctcgccagttcgaggcgataatcatgtcgtatccatcctcgagctggagcagaaaaccaaggcatttgcaccacgggtccatgagaaagtcgaaccgcttctcggggacaaagaaccccgtgcaaagactgaggatgtgaaggagtgccttgtggaggtggccgatgatgggctgggtgaggtggagttctgggtgaggcgtcgaaaccagagccgcgtgaatcgactctagttttcgggcggcttcgcgagctgaggctgggttgatggacgggaggtcgcttatgtaggacgcgggttcccatacctgagaaagaaaaaaaaaagaggtgatgagggaggatgagtgagtttccaggcggccatggcgggctcatgcatgttgaaagttcaacgcgagattgaagggaagggcctctgacctgcctgaaaaccaccagagtttccttcgaagggctctcctgcatcagaatatcaagcggaagcgagtgttcagaaagggtaattgaagggcaagtgacaagttgcaatgcacacttcacacctcacatttcacacttctcacttcactcttcaacacactacaataaacaacggccattcgtgtttacgttgacagtcattcccatatgattttttaataagagtttttctccctgtgattggctgaagcgacttcaatgtttattgaagcagttttggcgcccacagtacgcgatcacaaaggagacatgtcttgaggcctcttgtggttcatctgcaaaaaacaacgaggcagccgggatgtgtccctcggtcaagtcctagtcgtgcttgggcttgaaaacgtccttctccttgcgtaaaaagtcttggaccgacttgccctgatggcccagaatcttttgcaaatcgtccgaggcaaagccggccctgcccctcttgatcatctcaagctcatccagaagcagctcgatcatggcctcactagtgggatagtactcgtggtcgtcatggccatgaccgccgccaccagcagcagtgggagcgtcctcagagatatgcagcggcaggactggacggtgcatcagcgactcgagatacttcttgagctcatcacgctcgacgtgcctaagcttgacctcctttccgatggcattgctcaactcgcggacaaagtgctcaggcgtgagctcattagggccggtgagggtgtacgtcttgttcttgtgagaaccgaatccctcagcttcgcgatcggtctcttgacattttttgatcacgatggaagtgatggcacagacgagatcatgggcatcaagcggagtcatcttgttgtccttctcgatcgtcagagggaactcggccttttccttgacggcaaaggaccagaacaagaagcactggttgaggaagcccttgcgcaggatcagataaccggaagagcagcttttctgaacttgtttctcgagttcgcagaaggactcgatcgacttgaggttgcaattctcggaggctccgtcgcacgagatcatcatgcaggacttgacgccttgcttgttcatggcgtcaaggacgttcttgccgagctctgcacgacgctcgtccatctcggggatcagaaccgtgcagcggacaccttgaagagccttttcgagctggttcgtgtcgctgtagtcgaccttgacgacgtggacgttcttgagacccttgagcttgtcgaggaggtcggtgttgcgggcgagacagaccagggtggcctctttgcactccttttcaagctcttgggcgaggccgtaggcagcgcagtagccaagccaggaatcgacgttggtgatagccacacgctttccggtcgcggcagcagatgactttgaaaacatggcaggtggcgaagggtggtgtgaaggggtgggttctcgttttggaaggggatatagacggctgctgagtgcttaacaagaaagaagtttactgagtgtgaagctggaagagaaagagagagatagacaaacagagaggaagctggtctggagaacagtgatggatgccactgatgccctatttaaagcttcgcgtcttttttcaagcatcgcctcaatcagcatagctaggaaagatatgccctgttgtggctgtgttttgtatcacgctagctcaaaactaaattgcctaatcgaaacagcgttaaaagaaaaggtgagacttgttcgctgcatgacggttgcattaactgcatgtgtaggagctggctgctctagtttgcagcaaatcaacgagaccttaaagcgtagcgaggagcaggctgcccaagcgagcgagcttgccgccgcaatgcgtgagcagcagggcgcgccagtacgtcgtacggtcgtgtttggcgatgagccaattgtggcgcacaagccgctagcaatcactctttggtttctgatccacgccgacaggttgttcacccgcgaggttttgaacatgcaacgatgctggttggcataatagggtgcgacagacctcgatacatgtaccaaaacctttaatttttacgctataattcttatgccatcaaactgccttccttgacagtagcctgtccattcatagtgaaattgcgggcttgatgaaaatacggctaaggtcgcaagtgcaaaagtaaggctaaaatgcggcattgtacacgaaggctgtggcattgcccgtggacatgcatcccaatgtgaagcaggtgttgcagaatcaacaaaatgtcatcgtgcggcaaggtgaggctataagcaggatgccaggaaacctcgagagcgtggggcaagaggtacagcgtcttcggagcgatacagctcaacacgttgatcaagccatgcaatatttggacgcaaaattcgactacggcgtaggctacggaaaagattacgccctccgcatcgagtccaagttggattacttgatcagccgaattggaccacaggtctcttggctgccatgtgcagcgccatgtcacggatacaatccttcgcccgctccgccgcctgcctttgattatcggtatgaggagactcgatcaaccgcaggaccgtcctttcctcctcgaggacccgcaccagtgtcgattgcagcctcggcaccccctaaatggacgcctgttgcccttcaacagccgatgctacaaggggccacgcagccatcattgaccatgacgacaacagcgaccacgacgactacaactgccacaaccaccaccagcttggtagtgagcaacctcaaagtcaactacaggcttcaagacgtggctgatatctgcgctgaggttcaaaagtacgaccaagaaatccaaaagtctggcaagataaaggtcccttcgttcgagcggaaacaccagaaacaggttagcaacaagaggcatgttctcaaggaagtcgaatatttggcttcaaaacttcgagaagaagatgtcagtcttggtgaaggagacgccttccgtatggcgatatcaaagctgaatgtgctcaagcagacaggctcttggtctgtacatcagttgatcgagcattgtcgagtcaagaaggctgcaagagacaacgctcaagtgtcccgagaggaggtgcaatgagtgctatggttgcagaactggtatcagacccaataaacgcagcacaaggcagtttcatgatgatatgatgaactcttatatgggcgtgattgtctaaacgtgtctgtgtgcgtgaatgagggtatgaaaacggtagtggttatgatggggtagtataacggatgttagggctgtcgccggtttgggtggctagacgaggcgagcacaagactggaataggagaagatgtcaagatgttgaccttggcagcatggtgaaagcatcctcaggaacggccctcaaaagtgatacctaaccagtacatcgttgcgcaaatgctctgcgtgatgattttactcttgcaaacgcagcagataggcagcgcgacaacctctgctcgctgacagcttatgggagccaggacagtgcaaatgcagaacgctctcagtgaagtgggcttgatggacatgctcaaacctaacgtgaacgataagttcaggcttggccaaaaatttcatgtcagacgtgcgttgctgaagaatataaaggtatgaggttatgcacattgatggtcttgtagcacttgcgcgtagtgacaaactaggacgcatgcaactatagtattttgcacgtgtacatacaccacgcactgcgcccctctcgtcttatcacctttggtgacagtaagccgatctgtcagtttaaagagcagaaagccgatccatcagtttttgagggaccattcacgagaagacaggtcgggaaacgcgaggtctggtacaacccccccccccgtagagtgcaatatggacccacctcctccctctacaaagttgacagatcgggttgagaggtgagaagatatccaagcttttcggaaacggaaaggctttgaatgcattgttgaatgcgttgttttgactgaacaacagcaacggttccaacaacccgagaacctgagaacggagaatggcgcaggcgacactggtaggggagattagaatagacatcttgggcattttttttttattttccttttgtttgtttgactatttgtttgttttgcagaccgctgcagcaatgaggatcccgtgttcggctcacttgttagaccaaggagcagtggacggaatggatgttggtgtcacactaatttcgggggcacattcttcaatctgaagtagcacaaggccttcacaaacaagctaccgatggagatcgaccaactttgaattcaaaaatgtgacgcgagatccttcaggacgtcgcgagcgatcatcgcggcgcgtctttgtctgctaacaggcttacctccgccccgtcggctaaaacaaatcgcccgtaggatgcggaccgtctccagagtccagactgtgctgtaagactttttgctcaagtgaagttacacaagttgttcgaccgtcagtctggaaaccagtgggtgctcaagtctggttacacggagtgttcacaaacaacagaaccgaaccgtagattcccaggctaaaacggacgtctgcaagtgttttagagccgcaaacatgcatccaccttttttttttctttttttttccagtggcacgttgaagggaacattgcaagcaaggtacgtactcctgccatccgtgtcgcttcatgcacaatgagactcatttttgtctcaagttgtctatgttaagaaacttggttgtcgcgtgagttccccgctttgctgtgcgcatcaccaggctggtttatacatcacctcaggtactcgaactttatcaatacccgatacagcaacggacctatcccggcgtgactatttggtgtgcagcatgctcccatatttttctccttgcgggagtctttcctccgaggcttatgtggcccgaactatcatggacaactgtttttggacaactgtttttgttgttaagatatgtatgtacgattttatatactatgccattagtgataaactggggtttgagggggtgagcgagggggtgataaggagatgggggaggcgagaaaaaaaatgacccgacgatgcaacgcttttgaattgttttttttttttttttttttaggcggcctgaggggctgcaatgttttggctggcgagaatttccaattcgcggttagcacggtacgcacggccggcttcacgaccgagctcgatctccttgtgaacgccacgaagcaactccacgatctgatgatcgtccagatccttgaccgtctcggccaacgcatgcctcacggccagcacagagctgaaatccttggccgtccaaaggttgcagacagggaaggccaccatgtgcagcctcttggaccagcgacccacacacccgcactgactgttgtagctgcggaagaggttggggaagacattgaaacctgcgcagtccagatacgtcgacagacgagccttctcgttcagggacaaatgacgagaggccaagcccgagcccagagtcgccgcataccattcatccacagcgccgttctcgatacaacgttggcagagtccactgatcgaggtccagtcataggagctggcgatccggtctgccagctcatcctcagcagggagagataggccgatcgcagagacgtacggtgccatgatctcagagttcttcttgttcgtagggatcgccaggggggtctggttgtacttggccaggttcgagtcgatcttgttggcgtcaaagtgaataaatcttgccaaggtgtagttgtgacgggccgagtggtaaaagtacaactgagccgagtactgccagcgatcaatgtaatcgaaatcgccagagtcccagtactcgggtgtgagcgtggccttgagctcgtgcttgacacagtcaccgcagagcatggcaccgttgttggcctcaccctgcgtccactcgtcgtagctgtcggggttcgcgccaaagaccatgttgctaagacggtaccgggagcggtagccttcctcctccatcaggtcctggtgagactcacagttgacgtggaaatcagcatagcactgcgcgagtagcatgcgctggcgctcctcgggggtgaggtagcagagccatgcggggcggatcaaggtgccggcctcttgacgctggacctcgcagatcttctcgtacccaagactggcgttctgtgcctgatgacccaaaaggacgtgctggatgtttctggagtaaggaccgtggccatcgcggctgaactctgtggcctcggcccagtcactgtccgagacccaggcccagctgagggtatagagcttcttgcggaggatgggatcttcgttgatggagctgctggtcgcgatcgtcagactgatggtggtacagctgtgcatggcctgcaggggcttcttcatgtcctcacggaaagagatggccttctcgctcttgccagcaccgctgagcttcttgacggccttgtactgggcagcccagaggtagtgatcccccgcaaaatcagagtcgtccagaggaccgtctccggaacctctcatgaaggctgcggccagttgttcctccgtgggctcgggaccctccaggggagcgggcttgggaagctcgttggcgtagtggcaggtctcgataaggaccttgctacggtaactggagagcatgccagcggtggatttgtagggcaggtcctgctcggtaatggagccctgggtggagtagtagcgcacaaactcgccaatcacacgctgactgaccgggtgttgaagctcaggatcgggaatgacccgcttgtaaatttctctctgtgtggcagcatcaggtgcgactcgcttgtttccgatgagagcgggcttgccgagacaatggcgcagcttgtcgtccttgaggaacgaaaatgtggccctggcatgatcccctccagcctgtccaaaggttgcctcctcacaggcgtccaggatgaccttctggtactgctctgccagcgacgtgggctccgaaggtgcggcgtctgaatgctgggtttcagaataatgcgctgacgcgatagcggccgggactgggggttgagcaagcatgacgaatatgtccttgttgtttcctcgaggaatgaggggcgagcggtctgtttgctacacgggcgggacgaaaaacgaaacaatggaaaggttggggttacaatgaggaatgaattttgtaagcttgatagatggtgggtcttttgtagtgaaggggaaagcggcgcaggaggtgctttctcagtgatggatgaggttctgctggagcgccggtattgtcaatagcaaggatagcagtccagaagattgaaggatcccggatcccggacctcatgaaagtgtgctcaggcaagggttattcttcacttttcttacaatctgtggtcgttctttgtcgctggactgacgttagggcagcgagattcggaaaatgcaaatcgaaatcgtcgaggagagtggactgggctgaagatgaagaagtgagacgaggcgcttttgttcgacggatgccccagaaatgaaggccctttatatatatggtgctgttgcatagttgtacgacatatcctcgtgctgcattctctaacagtcgtaaaaatggtatgagaatgagagcgaggtacagtcttcgttgttttgcagcaagaatggattttgcgccctcgacggcagccgttaggctatgcactgaaatgcatgcaagtccacctggtatcgcaaggtggtcgattatctctcccttcaacagaagagggtaagacactcaatgttacactgttcaaactgtgttcttgaaaaaaaaaaaaaatgagagcatagacatatacactagattactatattgttgtaagagtacgctaagaaaaatatatattcagcacaggagttgcacggtgccaacgacgacggggttgataatggctcaagtctatataaattatgagggtataaggaaggacctcataacggctctcagcatgcacgggaactagtaaaagcaagagaaggaccgatttctatgcagctcaaccttaattcatctcaacagcgaacgagaacatgtctacggctttcccgtgtgggaactcgtaatgtggcactgaaggatgtgcgcccaatttgtagcgatctctctgtggaggaggcgatgatgggcgaataaattcctatcacattggagtgtcaaggcgtgaacaaacattaaaccagcccacatgcaaacaagggttgggacagaaaaaggaagcaaagcaaaatgtaccccgaaacggatacgaaggtggcatcgccgcttgcgggaagaaaatatgaaagagcataggaaagaacgaaagcccttcgccaatgcagtgttctgactcccatttggccatctggggcctcagctctcattgttttacttgtgcagatgggtggacccatgcgccaatgggacccacgacagttcttcttctagtctatgcggcttaattggatcgacggtattggatcgacattccgctcctatgcaccttgagcctgcgatgccgagcgctttgcgggcccatcgaagaacgggattcgaaaattctgcgggcgttgtgtccttcctgcaattagggaaaaaaaggcgaacggaaaccttgaatgggatgcgactatcccccaccgagggcccatgaataaaaaaaaagcaaaaagaaagtaaaaagtacgcgatatcgatgtacgtgtcgaccattgttgacttgaatcaagggggcatgtctctctcgagctagaccgatgaacttttgctttactgtgtatgagaaaagtttacaccattgccaggcgacgtctaaaattatagactctttcgacggtatctttctcgctcaacgtcgcatagtctacgatggcttacgagcacaggttgttccatcgagtatgccacgtttcggcgtcactccgtgctcagaacgttctgtgcttggaccgcaagcaactggaggacaagaatccgaggaaccgacacgatctcaagtttcgccgccgtggttatgaatcgttcgagagcttgaggcatggatcaaggaccaaaatgtccttacttgggctgtggtgtaactcggaggtttgggaggcgagctgaattgaagtagtgtggtgtcacaccagctgaatctgagtcgggaccgctctattcctagagacgaatgcgtgaatgcgtgccaatcgcacgttattccttgaatgcagttaacagcactactgcatgtatcttgcgcatgtcagtacaggatggagcgggcttcccagtctacgaagccgatgacggcaggtaaagaatgatttcaacactttccgctttatattgagcaccgaagatagaaaggtacatggtggaagtatatagaacatgtgcatgagcatggagcgcaccaatggatctaaccctcgcggaaataatgggcaaagagcgataaaggcgagggcaaggtcaagggcagggacggaacttaaagaccaaaccgaattctctacaatcaacaatgacacgcctgtgcttgacatgactacccaacatcttttgtagactgaacaccgcctgttcttcggcacgtcggtgctgtggtgtagcaaacaaaaacgtagtgagacgaagatggtattagcgcgtctgacttcggctcactgatctgtctcaatgctccaggcgcatcacacctgctgaacagagttctcataacgcccgtggttcctattccctttgtaaggggggatacagccgtagccgatacttctttttttactgatacatgaccaagaaatgttcgataagcgatcggggagcagctctttactttagatggtatgtgctacgttgagcttcacgcccgtagcgccgtaatgcctctgaaagagactgctaacttgtttgaaattataaggcaagtcaatcccgtacaggtctggtgcggtccaaacgagcttcagtttgggcatggcctccatgacgatatgcagataccacatcttcatcatcaaccgcgatgaacctgcggatttgagtgtcacctcgcgaaccgaaggtaattgcgggataaagttaggaggtgcggatccgtcccgtgcccagacctggcattgcgattttaaaacacggcgctgttgctcagtcaaaagatttggaggggcaacagcggcaggcgcttcgatttccagaggcccaacggcagatgacaagagagaagtggcccgcatacgctcctctcgctctctcagccgttggaggtgatccaaataatccagaaccccgcggaacgctgcatactcctcactccgactctctgagagatcgttcagcatcttcatcggcagcaagaggtgctccagtgctgtcaaatcctcaagtcgtctcatgaacgcatggagtctcaggtccagctgctgatcttgccttagataggttgtcctgatttccagccgcctcagcgaaagggcgcaagcccagtgaggaaatgagcctgttcctgaactttcagcatatgaggcgggctccaggccgttgaagtattgaattccgatgacgagatttctcagcaaacggcaggcagccatcatataatgcaaggctctgtcctcaattctcagcccgatgtctaggtgcaaggagactagagttgatcccggagatgaatcgtcgatgctcgaaaggcaagaaagtgggctggtaaagggctgctctgcatagaatccatgtggtccatgctgttgagtctgccgatccataggcgacgagaaccgtatccgtgaattgccgttgctcgcgatgtggaacttgtccagcgactgtggtgcaatggtccagaccctcaagatatccatacctactcctgcagcgtcgctctcaactttgatgctcttcattcgcgtgcagtgtggcagccatcgcgaccacatatcgaccgagatattacaccctgtcggcttgaattccaaagaggtgagtgctggacaccgactcagaatggagcagagcagctcctccgagatcctaacgttctgcaggacaatgctttcgagatgattgaacgcgaacgtgtaggtatcctgctccagcatggggtttaacgatggtggtgcctgtgcgaaagccctccatgtggtcgacagaacgtccgctgcagcgttcaatgcattgtggatttgaacgattggccagatagggtccgatccctcccaggtgcccagaggttcctccagcagcagactgcactcgtgtattgatagcgactgtatctgacgatggttcgctagggccgcgacaacttgcttccactgcacagttgggaaccgcacactgtgtgttgcgtgcgtaagcgtcaactttcgtagtcgtccggatggtctacacgtggcgagacactgtagcacactggcgaccaaaggactcgcataggagtggaccgtcacctcttccagagtggtcatccgccccagaaacccggtcagggccctggtgtgcagcatctgcttgttcctggtatagagctcaatgtgccgtagcactgtgcaagtccgagcgatcaactcgaggtcgctccggataggatacaccagcctcaagacctcgacatacgggcccagggtgagaagatggtcgccgaacgatgcccttcgggcacggtgcgggtctttgcgctcttgcccgtggttccagaagaagggatggcaatggaggaagggcgagaagatgcgtcgccactcgtggcagacgcctcggcagtagaggatctcctttctggagagccatgcagcgatcagtgacacgatttccggaatgtggagggcgtgttgcttgggtggtatgatgaggctctggtctgtgggctgtgcatggtgcgcaaggtgtgcatggtctggatggcagctgctcattggacacgttcttttcttttatttcgtgtgctgcgctcacgctgcaggtcaagaggcagaaggagaagtattatggaaggagtcgacagcaagcacaccgacgctgcgacgtacgcgaggtgtgaaaaactgaaaagggtgtgttggccaatccacctcaggtcacgcccccctcgttctgctgtcccccaatgggcgcgttggtgtgcgccaagcgcgctcaggtgcatcgtgcatgctcagggcggcaactgcccacacgagtgctgaggatgctgaggatgctgaggaggaggacacggagtgtgcggagtgtagattgagcaaagcgaacatggcgaaagacgtgcttcaacagggccatgcggtcatccaagagacgggcaagcagccctttcacgtgggagggtctccgatgctcgtgggactatgatgtgtgccaaggatcatgagctgggaaccccatgcacccacactagacactagaccctagatacatgatacatgagtataggagtggggccagccgacaacagggggggagccattgcccgtttaaaagagcgacccttaaatctaccccacccctgcccctgctcccccggggccacaatggctcccttcggacagcccacagtcgaaggaggatgccatcgtgagaaagcacaatctcgcacgattaaggttgctcaggcacacctgggttgttcattttagcaagcagccaagcagccaagaccaagaggccaggacacgacgaccaacttaaagggggggaggcggccgatgaattcaaaagtccccgtaaagagacagggatttgcttgctataaaagggaaaaccgcttcatcctcactttcttagttcctgcacactcgttcccttcagccttgacgcactcacacgcacacgcacacaacatacacacacacacacacatacaatacagaccacagcaatgtccttgtcaggaaactcgcccgcaggcaccggccacgtcggcacactcacccccgatcagtctcgggcgctcaagcagctctactctgccctctttgagatccaagacaagggcaccgtcaccatcgtctcagaacccattgccgctcctgcagcccctgcagcacccgcaccagccgcatcagggtggggcggcggttggttcggctccgccacccctgccgtgcctgcagaacccgtcgtggaggctcctgtgacggtgacgctcgaggagattggactgtcagctcaggaagtgcatacctcgctctggaacaacgttctcggcgacaaccccgatgcactcgtcctgcggttcttgagagctcgcaagtggcatgtggcgaacggcttgttgatgttgctgaaggcgttcaagtggcgactggagcagaatgtagaggacgtcaagtcgctgggcgatgcagagctggatgcagcctatccaaagttccagcagcagctggagatgggaaagttttatgtgcacggcacagacaagcatggacagcctgtggtgtaagttgtgttcccagctttatgtttgttcttttgctgtttttttgttggggtgggtcggatgagatggaatcatgggaaactcttacgatgttcgaggaatgaagcaccgcgctcaaccgcggtccatgtgaatgaacactgggaagtgtctttcattgcttattctggacatcggagctcaagccagagcagctcgagagaatgggcacgaacaatggacggccatcgcgaaaagcgatgcgacggggcgacttgcaactcaaaccgagggcggcaactgaatcagacagtttggtgcctgagagtgacgcaaaaacagccttgacatttgatctgacaactttcactcccattcttgtccacagatacctcaatgtgcacctccacagatccggcgaccaggacaacaagaccctggagcgtttgaccatctacctcatggagaccgggcgtctcttgatccagtcgcctgtcgagaccgtcgcgctggtctttgacctcaccaactttggtctcggcaacatggactacagtctcgtccagttcttggtcaagtgcttcgaggcgtactatcccgaatccctcggcgccatcctcgtccacaatgcaccactagtcttttggggcgtctggaaggtgatcgagccttggctggaccctgtcgttgcttccaaaatcaagttcacctacaaaaaccaggagctgctggatttgatccctgcagaacatttgcccgattctttccagggcgccgggctagacaagtacaaatatgaatatctggcccctgtccctggcgagaatgacgccatgaaggacgaaactaccaaggcagcgttgatcgcagagtggaatgcgctgagcgcgaaatacgacgccaagacaaaggagtggatcggtctggctgagggcaaggacgctgaagtagcaaaggaaagggaagagatcgcaaaggaattgcatgcacagtatcacaagatggagccatatattcgtgcccggaatcaatttcatcgtaagaatgctgcgggacagtcggttctccagcctgatggcactgccatctggacgtaccataactagcgagctccataccctaaagtacagttatataaaaatctgagcattctaacaaggccagccgttcatgacgactaatcctcgtattgatgaccttttgcacgtggcaagagcctttcggtaaagtcggcgtctacaacgtgcagaagcggccaagaatcaatttgtggagcacggccctatgaaccgcgttgtgatgaagttgccagagccttagcgtcacccataaaaagctctctttaccgacagacgggtccatcgggctaactgcgtttggcgtcatgtcatgaagcgattctgcttagcggttatttttacgctgcagacattcgcagtctacagccaagcgattcggctcgtccaggccatgctgtacagcccgattggtagaagcgaaccgttgtgtaaattgggagtgctgctaacaaacgactgcccatgctgcgtttagatccatgggtatctcattcggccgcatcggatccgcccagccaggctcggttgcatacccgcaaccagtctccatgagtgtgccgattgaaattccatataagggtgcaacttcccagagggcccctaacgcatcctgcgcaacactttttttttactttttcaccactacggccattctcaccattactgtcagttctaccaccagcatcactaccaggcatttctagtggactgctaaagaacctatttcacttatcgtgaacgtcctcccacgaaaagcgttagatgtccctacgcctgcgggcacaggttacatttccaatttgtcgccagcgcagaagcaggtggtgaaagcgatctggaagttcatcatcgccactacggagacaggcgaggccgtcgttcctgtggagatgatgtacgatctccaaaattttgcactgacggcgcctggagcgcagtatgcctcttccaaggcagccatcgaggctggctggttctctgagaagaaggcaaataaggctatagagcttgctcggaaagaagggtacggcgttggtatggctaaactgaagctgattgatctaggatttaacgtcgaaaaaatccgaacctcattgtgggatagcgccggggatgacaatccaggtatgaaggtggacactgtaaagcagagggaaaaaggatcgccaggcaattgcacttgcttacatcagcgtacattttttttttgccacaaaaaataaaagacatcttcatgctacgtttccttcgcgcgcgcaagtggaatattatcaacagctctatcatgctgttaaaggcgctcaaatggcgtgtggatgaggatgtgttggacctcaagtcaaaatcagataaagagctcgatggcatgtttccggatttcatcaaacaaatggagctgggcaagttctatatgcatggtgccgacaaaggggaccaacccgtcacctatcttaacgtgcgcatgcaccatcccggtgatcaaagccctagaaccctcgaaaagctcattgtctatatcatggagactgtacgaacccttgtcaaaccgccctgcgaaaaggcgtcattggtctttgatcttacagggttctctttgagcaacgtggatttttctctcgtccgatacttgcttcaaatctttgaagcgcattatcctgaacatctgggccttgtctacattcatggtatgccattcttcttctggggagtgtggaaggtgattgagccgtggctggatcccgtggtcgcatccaagatccggttcacgaaaaaggatcaagacttacttcagtatatcccggctgggcacctcccagacacgttcaagggcggactgagcaaatacaaatacaagtacgtcccagcgaaacctgacgagaacgtgcgcatgcaggatacagagaccaagaacaaacaggtagaggagtggaaaagcctgatgaggaggtttgaggctctgtcgaaggaatgggccgctgcgggaacggagcaggcagtctccacgagaaatgaagaacaaattgaaaaggaaagaatcgaagtctgtcgagcgatcagggcggcttatttcaagaaggacccgtaggtacgggccagaaatatgtttcatcggatgaaccccgcagttagcaaggacaacggagatgtggaatggacttataatctatagctgtttcgattaatgttcctggcaggaggaccgaaatggacgcgcgtcctcttagtttaacaagttttcttgcggtttgttgatgtgaaatacactgcattaaccttattgctctttgtgaacgctgtgtccttgtctcaccgccgctaatgacactacagcagtagaaacatatgacaatgagaattgagggtgacactagacacggcgacacggccacatctgttgactgtccacccaaccttggaaggggcgataagaatcattgccccaatcgcttcctagtcgaggttttggagcagatcatggccgtgaagcgagccgtttcaggtttgacgagatgtcactttggttttcatccacaaatgtacaatcgatgaggaaggaaaacgctatgatctcatattcgcctgcgagaatgtggcggataccaagattgcaggcaccggcagctgtttacaatacaaaaacccgttttctcggctggctagggcgcaagtttaggttttctggttggtgtgtttgcaataaagtgctctcagacacagcgtgcgccatcgtgtgtgttctgttgttctgaacttctgtgtgtagagtacatgtacatcttccgtacaacccttgctgtttttattctacacgacctattctttgcattgtgggcctttatgctcatttttttttactgtatgaatatttgtttcgatgcttgtttgctgttgcctatcacttatgcatgaagatccaattgtcatatgcgaaagcatggggcagtggccacatttcacgacgtgagttggtcctcatctgtgcgcccgtgaaaaggagggcgggttccatgtccaagattcttgagcgacaatggggcgacacttgagtatgttcgacaaaaaaccactctacggtactttccagccaccaggcgggcgctcttgtaccctgggttccgaagagcactcgaattccaattttctttagcggctgttcaattttggctatacccctggcatgtggagttggagaagtggaggtttaagcgacaggtgccttgttgcatgtggagaaagcgcaactttgaataggcaaggcgcatccttttttattgtccttatctatcgttaccccacgcgccagtacttgtgataacggcaccctgtccatgccgcactcagctttcctcttcgttgttcattttttcttttttgctccactcgccaccgcaaccccaacagagtttgcgcaattctctttcccttacagtgctgtagcgaagctgtacatgtctgcagataccttgccatgtggtcaataaaccagggatatgaagcaaacttggaggcggttatagattcgcttgaattttctaccccgtaggctacatctcaatgacactttgggcatttgaaagcaatagtgtatattgcggcatttgtaccttggatccaaacaggatggtctcggctccttgatgtatctaacggtcacctggatcgtatcaaggaatgaaggtacatgagcatgaagtgttattaggatagggtattcgcgcacagcaatgcgcggccggtccgtttatgcattgcctctcatgtgaaccttgaggccaagctcgtgccaacggccagcaggccccggtcggaaggtgcagagcgtacaaacgaagtagagtcagctagtgctcagtaggcggtgtcaggctgtgtccgcattggcaagtgtggaaggtggagaaccttgatgcggttgcaatgtccgccgtggaggagagcgagagagggcctggctgaagtccttgtttgtgtggacggtgtggctccaagactagcctgaaaagttgctgaggactgcagggctatcatatgcaagtgcgcttcgatcgaaccaagagaacaagggaacacgacaggacagacaacaaaaaagcgcaggcagtgctctcaacccatttctcgcctgttgatctcgtttgctcatcgttcccttggttgcgtccattccgtccattgcacctgccactgccccactgcacacttgcacacttgcacactgcacccactgtcagccagcaaaccttctttttgttctcatctgatctcacgcttcccatcccgtctatataaaccacgcgcccatccgccattgcccttcccctttctctcctctgcctctctcctattacattcgcccgtcgtctctcgcatccgcgctcactcttcccacccttcgcactccctgttcctgctcctcggacctgctccatccccaccccccacacactaaccttaaaaaaagtaacaacaacaacagaccagcagacatttcacaatggccaaaggtgacatcgctacccctcccggcaccggcctcgtcggtaagctgacccctgaccagaaggagctcctcaagcagatgtgggccgagattttccagatcgcagactcgggtgtcctggacgtccccaacgacctcctccccgccagcgtggagacggcctccatcaagtccaagacctcgaccgccaagaagggctggttcggttccacaaagagcgcccctgctgctgctgctactgaggtgcccacgacccgcgtgaacctggcggatatcggcctctcggtcgaccagctgcgccctgccctctggaacaacatcctcggtgatcacccaggtacagtgaggatagcacgttgattaatttgggttgttttttttctcacacttcctccgaactgatgtttggaagtgaggtctggatgggactcgacactaaaacgaccccctttgtgctcaatgtacctctccggatggtattgttcttattctgacgtatcgaatttccgccacatagactcgctcctcctccgcttcctgagagcacgcaagtggaatgtgacgaacggtatgaacatgatcctcaaggcgttcaagtggcgtctcgaggatgatatcgaggaggtcaagtccaagagcgaggatgagctcgatgccaagtacaagggattccgtctccaaatggagatgggcaagtcctttgtccacggcactgacaagatgggacgtcccgttgtgtaagtcgatattacagaaggctgttggggaatacgatgggctttttttttttttgtgtttgtcttgtgcaccggaatagagtgggacgatgatgaggcgatagacatctctaacatctctaacatttttttttcgattccctgtgttcagttacatcaacgtccgcatgcacaagccttcggaccaggaccccaaggcactggaaaagtttacgatctacgtgatggagaccggtcgcctgatgatccagccccccgtcgagactgcgtgcttgatctttgacatgactggattctcgctctccaacatggactataactttgtcaagttcctggttcagtgcttcgaggcctactaccccgagtccttgggcgtgcttgtcatccacaaggcacctttcgtcttctggggagtgtggaagatcattgagccctggctggaccccgtcgttgcttccaagatccgattcactcgcaatgacaaggaactgaccgacattatcgatgcggacaagctgcccgtcaagtacgatggaggcaaggatcagtacacctacaaatatatccccgtggctgccggtgagaacgaccgcatgaaggacacagagaccaaggagcgtctgttggaggagtggaaggcgatcatgtggaagtttgaggctctcacgcgcgagtggatcgcgtgcaagaagccagagactgtgaacccaagatcagaggaggtcattgaggaggagcgcttgaacgtcaccaaggatctgagagtcgcttacttcaaattggacccctatatccgtgcccgcaacttgtaccatcgctcggagcaccctgtcctccaggctgatggaagctcgatctggacttatcagaactaagaaagggacaaaaggatgggccgacactttttgcctcttattctttcaattttacccccctctacacacacccaccaaagacgcgatggtagacacaactgttgtaaatagaattaaaatccgattttttatctagcctgaaggtacagccataatgtcggacgacgcgaggaacttgaagacgtaagtgtgcaggatatcgggttaagaaatctttgcaaaggacgcggtagcccttcaaaagttgcgccgtcccgtcatgactaattcaaacccgcagaagagatattgttatggtttatttcatcatattaatgttgatgtttgttcgagtgtcacgagtgaagtccttgcttaccttcgtaccacatcttccaatcgccgaggagctacaatgtgatgaaaggaattagtttgataattctgtttgttgggacctcgttacccactttgaggagacatcatgaatggatatgcttaccgagtagaagggatgcttgaaagtggccggtctgttcttttcaaatacaaagtgtccaaaccacgcgaagccgtatgctgaaggaaggataggttagacatgagtcgcatgcatgccccgcaatacttatccagagaaaaacttaatcggtttcagacaagacatttatctgttgtttctttaccttggacaaaagttacccaccagtacttggactgccgagaggcgagcatgtataataggatggcgaccacattggtcgttgctgataacaagaaaaaaaaagcgcgtcgtccccagggggagactgtagtattaggatggcagaatgagttgctcgtgataagtgacacgaaaaaagaaaggcatgggttaccaaagagatgcaggcgacggttgatggggttgcagtgctcggacagatagtagggatagaattcctcaaaggacttgtatccattggttttgtaagccctcttgctgtagttgtggtttgctatttccttgctgaccttttgcactgccatggtcgtgcgagtgacacacttattgttttgtcaaggaacaagcgatgatgtcgggtgaatgcggctgatttccttgcaagtagcgtgagtgatgggtaaaggaattgctgcagcagaactgatgaatggcgaatgtgggaatgagccgttgcaagcgagatggacctttatgcagtagtccgcagctcaaagcgaacgttgatgcacgtgcacgattgcaccggctgaggcatcggagttatcgatcgaccgaacctctcggctccacaaagtgagaaggttcaaacgaacctaaacttcttcagcactctgtctgctgctgttgacaataacctgcttgctgatggcatcggcgtagacgactttctaagtgtcatcagtgcctgtatacgaagtggagatggacctgttaaatttgtgatgattttagcatgcattggaccgacagtggctatcgggcacccatatgactgtagagcctccctgaggatgagaagcgattcgagggtcaatatctttgagttctggagcatttttgcgcgtggctgtgagacaggagaggggcttacagcgtcgaaaatcactctaaacctttgagggtgtgccgatggaaatctctccgtaaaagtagtccaccgtttgctggaccatcgtcagtggaatatgaagggctttcctgcgtctctgagcagttctacggatgtcggcgaccgccttggggacatgagcaccacggctattgctatggcgatgatcgcccaccaaaaaagaaaggtgatgaagatcattggcggacaaatcatgctgaagaatagtcggttcagtgtggcaagcggttcgtctttttttcgcttcatattgatcttgtggtctgcgggctgctcgtccttggttacattctccaacaccatgtcttgagcctgatccagtgtctactatggccatttccatacatgctagctatcagcttgaccaaaggcaccagaaaagcaagactttgaacgccttacatttatgaactggcaagatcatgtgcgggctcgcccgctcgttgcctaccgtggaaacatgagcctccacacgccacttcgaaacatggcgttgagcagttcttgattttgcatgttggtctcggcgcgaatgaaaatcgtcaagagccacgcgtctgaacccatgcagcccttgatccactgttgcgtcatttgtgatattgcttttcttattacagagaccgggtattgatggtgaggacgacgacagaggaacccgagaagagatagatgtccgttctccgctcgcttttagtattagtatttcaagggggcaaagccgacacgaggcgtggcactctggtcaaagacgcagtaatgatttcttgatgaactcgtcagagagatccgtgttttgccacgatttatgtgagcacaaactaagtatcgctaagcatagttgatgtcgtgaatctaggcgggcaaggacagggcggtggcaaaatgacctttcgcgagggcggagggacaagggtatgtgtttggacaaggaagagggtttgcaaggtggggtcaggttgtattcaagacactaggtaaagaataaactaaagggagagctacgggatatagacctttatactaaaagatgggtttgacgcctgattccgctttggcccatggtcatcgattatgactggttccaggtctctcggaacaggggcgcttgaaaacacggcagtgcaaggcagtgcaaggcatggtctaggaaactacgaccaccctagaccaactacgcgacatttgatccaagaccattcctcttggtgatatttatactttgagcgccaaactgcttcaatgaatcgtatctgcatcttcttttagcaattgctacctcgaccgcagttctaacagacgtgaacttgcactatgggtagacagatacctctttcgtatgaattaaaagtttgccggcaattgaacgattatttgcgcatcattgtactgaagcagttttgccgcagatcccgatatccttgaggcgttggcaggtgatatattgagtttagcagcaaattccctggtggagaagccttgcttcattacttgtgtgcttctttgaacctgcttgcaagagtcgcctgcatatttcttgaaggcccttctggatgttgcagggtcgtttgggataggaatctgagtgaaattatttactgacctccacgtcaacaacgtagaagtaacgtccgtagcaacatcaacaacatcactctgaataatttgatcaatttcatcatcctgtcgagcagcgacagcattttttttcttgatgcaggcaggagtcaaagtcatttctacctaaactcagaggaaaagctgatcaggctttttcttagcaccctcgtaagttcctccgcttgtcagcgttcgcttcttcgctcctcccttactacttctattttacctcgtcccttactatttctattttaccacttttaagtcttccaatattaaaaaaaaaatgcactatgaaataataataaatgacgggtgctttggagcctcggttagccttgactgaccttccgccatttgaaaaatttggagacgaggcagacaaatacctcaacaaaatgcatggacattgacaccatcgaaggtttgaaggcacttctacaatgaggcagcaggaacctgagtgcaagctcatttgttactgtttaggtcaatggtaagttttctttgaaccccccagcttctcctctatcatgagctttgatcaccgccatcatttgctatccgagatcatttcccgcttctttcctcgcgtgaatgccatgcactaccgcgtgccatcagtctatcattgcctacaacgacggagttaatgtgcatttgccatccttcctacttccaccttctagaacctcgtccactcaacatcaaagaaaggtgacctgctgctgtagaagtaatccgctttggtagaggtcgcgcggtccgcaaatattccccctccccaccctccctcgtcaacaacacgaaatacactatagtacagccatttgtatgaagcccttttattaaaactcattgagtgaacccgattaaaaaaaattcaagacgttattgattgttgacacttcaaagtggcgaactcatgccctcgggagtgacctttgtttggagcagtatgccacagcgcaaaagttttgttattgagaatatagtccttggagaggttgttgtgtccaccactgacgtcctacgcaagatgcaactaactccagttcttgaccgatggtcttaaaaaggtacttatgggaggtcaaaatgggttgacgaatccgatacatgtttttcatccatttgaccgacgatggttttatccggttcaggctttattagcaggcgccatattttacaatactaggaatggcgatattttacaatactaggaatggcgaagcggtcataactaacacggttgaagtctacggtcgaaagatcaccgtatacgctcacagagagcggctcagcgtgaagaagggcgctgtgagcagatcctcattgctaaggacgcggtaccctcttgtgtagccgctgacgttcgcggacaccgaggggcgagaagctcctgcgtgggacgcattcattcaatgctctcgttacctcatcattgcacctcaactcaaattggtccgcttctttcggcggctcggtgtcgtcattcacgcctcgtgtgcgacaggactcaatggcaacccggatttgtctagacaaagaattcgtggagaggggagctcggcctggcaagagacggaaatgccagttatatttctgctttctttgcaaagcctgtggactctttacgcaatctcacacttgcaggccgtacacggtcttcacgttggccgacttcgaccaatctcagtcggtcgaggggcgtgcagcctcatcgctgttccaagcgatagccacaggcgtcctaacccaaggcctggaggcgcgccttgaactggcgaccgtgctggccctgcggtctcagtgctccgaccagggcagcatcgggagaattttcgacaagattgtcgaatctttttcgtctcagaaggccatcgcagtgattggcaacactgctttgaacgccgagctggaaggtttggcacaaatcctctccagctacatcagcaccgccaacaagtcggtcgccagctttgtgcaggactgctttccgatgtagaatatcaaggacagttgtgttattcaatacaatacacctttgtttttagttgacagatgaatgttgaattttcggctaaaagtacatgtttacaaggagagactgttcatgcttcttgctcagagcaaaggttcacgaatacacttgccactatactatatcgtgggattcgccttcatggggacctgggtgagcgtgggtcaaaaggagtgtcactgaatcttcactatcgtcacttgccgtactcaccacatcatccacgtccacagcttcatggtcaggcgcatggtccagacgtccacgagctcgcattgactcgacgccatgatctccgctcgcgttcccgtggcggtcaagactcgagtaaacgggaggcggcaccaacatgtcgggtggggagatctggaccggcaaagtccccgaagatccatgcccattattctgagcacccgcaggaccggctctactattcccgttcgactctccatgttgctgttgtggtggctgttgaccaccacgatcatgcgatgcattcggagaaagcctcgaacaaacattaataggttagtatatttcttttgatgtagaccgacgacaccacagtgcgtgtcccgcacctgtttgtaagccataattctcaggtcaatatcaagtcggtggtttggacccagggacgttgtgcagtgtccagagaagttcatcaaaaatgcagcgacactgcgcgtccgaacgtagccgttcgacgagtggcggtgcttcagtactgtccttatgcttgcctggctgaatggttctctccaatctgcgcgcaagtcgagtgggcgctagcagtctttctgtcggggaacggtaggtcagaaattagagtcaaaagccgctgaaataaagcattgtcagattctccagaaagcgctcttggaggtgtgtgttgacgttaagccgacatgtggtgccaagtgctgtggctggtgattgcagtgctttggctggcgattgcggtgctttggctggtgattgcaatgctttggctggtgattgcaatgctttggctggtgattgcaatgctttggctggtgattgcaatgctttggctggtgattgcaatgctttggggtggtgattgcaatgctttggctggtgattgcaatgctttggctggtgattgcaatgctttggctggtgattgcaatgctttggggtggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggggtggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcaatgctttggctggtgattgcagtgctttgggctggtgcgagggcaggtgattgcagtgcgagggcaggtgattgcagtgattgcaagaaagtcgcagcttcttgcaacgcggtcgcaggcgatgcggtgccaagtgctgtgtcaccagcttcagcaggcaggtgattgctggtggtcgcaacgcaagggctggcggctggattgcaggactgcaggaatgcaggaccaggattgcaggattgcaatccgattgcaggcgagcagcatgctacaacttctggcaagtcacgtgcgtctgtcttacttgcggccgcggtgaactggaacaagctgccagaaaaaagacgtgcaccaagacttcttgcttcccaatgctgcctggactctcttgccagcttcgagtgggatatctcaactcttcatcacaagtgggacaacctacctctttaaaagcatccattataatcgcttcacgagaagcttgacagttggtctaaactttgcgcaggcacaatgtactgtacttgtccccgggtctgttctcgtagtcctcttggatgttgcctcagggagggaacttccgccaaggagcaagggtgggtctgcaaggaggagtggattgattctggttcgcggtagagccttgagcacgcttttttcgagcactgaagcgtgcaactgagcagtggtgaccagacgtacaacaagagttacgagacaacagggcatgaactgtgggacagtgggggattttgcgaggcatatttgccgctcaaggtcggaactaacctacaaaggtccgtctgcctctcgctcgctttcactgcgagggaagtcagtgtaaacgcacaggagatcggttcgggggtcaaggggagggagggaggggggggacttgaacttgacggaaagttgaaggggttgggggtcgtggtccacgagaaaggttcgaaggaacgaaagtgtatggacggaggcgcatggttgaacgtgaacgtgcacgcaggggcaatcaatcttgcttgccgtacctgcaattcgccttgcctcgactgcaatcagtcttgcgtcgcctgcaatcagtcttgcctcacctgcaatcagtcttgccccacctgcaaatcgccttgcctcaactgcaatcaatcttgcgtcgcctgcaatcagtcttgcaacgcctgcaatcagtctcgcctcatctacaatcctcgcgaacgattactctgccagcgattcctcgcctactgtcgcattctcgtctttgatgtctggctatagcagccagcttccggaggaggagcccacgggccaaaggtgtcttgtctgcgtagcgaatgtcgttcttagctccgcggaacaagcacggagacatcgtttggagtaccactccgcttcgttccttgttcgcgttgaaaccagttcaggcacaacacgcgaaatcgcggtgaaacaatttgatggcgcctaccgttgcccagcctgtcaacaaccgtatccaacgaaaacctcctgccgtcgacacattcagcggactctctgtgccaattatgatccggaacaagtcctgccgcctattaccgtccctgtgattccagacattcaagcaactggctgtgctgaaccggaacaggtcttgccgcctgtcacagtccctgttattcccgacattccagtattacccttgccgctcgccgagaacataccaccggtccgagatcacgacgtggctgttctctctgcctgcaacttattggatgagtcggatgaagaaaagtgcaagaccttgtttattgtcgacgctctaaagttgcgccctttcgcccttcagagcgacctcggtgtggagcagtatgctttagctcacaaatccatccttgacaagcttgtcattggtgaggttgctgtggctgccactgacatcccgcgcaagagaaggtgcgtagaagatgttgtgaccagcgttgcacctggccttgaaaatcttctcggtgtctctccatatgcttcctcgctgctcactcggacgttcgtggagcttgacgagcccatgtgcgagttgttgaacgaagactggcgtttgcaaccacagctgcagtacgcttgtgctcaagcattagcaagttccatattttacaacactaggaatggtgaagcggtcatgattaatacggttgaagtctacggtcgaaagatcaccgtagacgctcatagagagcgcttcagcgtgaagaagggcgctgtgagcagatcctcattgcctcctccttcgcccatgacgcgctaccctcttgtgtggccgctgacgatcgcagacaccgagggcgagaagcttctgcttgggacacattccttcaatgctctcgtgacctcgtcattgcgcctcgactcgagctgtcccgcgtccgtcggcggctctacatcgtcctttaagctccgcgacccacaggaatcaaaggctacccggattttccttgacaaagaatccgtggaaaaggcgttcgccttggcaagagacagagctaccagttacgtctccgcgttcaataagtttgagcagcttcgtcaactgagaagcaagttccacgacggctccacctaccgcctgtgcagagccagcggcttcatgacacaatcgcacacctgcatgccatacacggtcttcacgttggccgactttgaccaatctcagtcggtcgaggggcgtgcagcctcatcgctgttccaagcgatagccacgggcgtcctaacccaaggcctggaggcgtgccttgaactggcgaccgtgctgaccctgcggtctcagtgctccgaccagggcagcatcgggagaattttcgacaagattgtcgaatctttttcgtctcagaaggccatcgcagtgattggcaacactgctttgaacgccgagctggaaggtttggcacaaatcctctccagctacatcagcaccgccaacaagtcggtcgccagctttgtgcaggactgctttccgatgtagaattccaaggagagctgtgccatttaatacaataaacgtttgtttatagttgacagatgaatgttgaattttcggctaaaagtacatgtttacatggagagactgttcatgcttcttgctcagagcaaaggttcacgactacacctgccactatactatatcgtgagattcgcctccatgcggtccggggtgagcatgggtcaaaaggagtgtcaccgaatcttcactatcgtcacttgccgtacttgccacatcgtccacgtccaccgcttcatggtcgcgcgaatggtccagacgtccacgagctcgcattgactcgacgccatgatctccgctcgtattcccgtggcggtcaagactcgagtaaacgggaggcggcaccaacatgtcgggtgggaagatctggaccggcaaagtcgcagacgatccatgcccattattttgagaacctccgggaccgactctgctgtttccggtcatctctccttgttgctgctgtggtggctgttgaccaccatgatcatgcgattcattcggagaaagccttggccgcgatccactagactgcagaatcggccttgctctggcagtcagcaacgaacccggtcgattggctgtcgccgatcctgaagaggcttcgagcaagattgatccaagttcactgccgtaggctggtggcggcgccagcgatccagaggcgggtgccagaccccacttcttgacattggcctccacaaaaacaaacccggattgtccaaagttgacgtggaggacacagggccctgtagcgcctacggtcggaaagagattggtccttccgaatcctgtgtaggcatcctcgatccgttttccattcctggtaaaaaagatggttccgtttcggggccggtatccacaaccgatcacgtcgccttcaaagaagggtgggccgtaagggtggttgttccagagcgagttgcagtatttttgaccattgtttgaaaaataccctacagagtgccgattccatcctagaattacaattgaaaaaaaacaagacacaagagaaaaggagacgcttgtcagcaacgaaaagaagagaacttttgtgaaaccgagtggggtgcgtgatacatatctcgcagattggttacctggcaaacgcgtcgtgggatatggttttgtcgatacgcccacggcgatggtcgtgttagggctcttttcaaacatcttgacctcccaatagtacacctcctgctgcttgggcaagggcaagttggtttggacactggcgacgcggtcaaagaacgagagctcggtgcgatcgtggacaaagagctgatggtcgtacgaggcttcaaactcccaggcagagacacccttttcctggatcgagagatactgcgacagcgagatgtctgtcggcacgctgttgggagggttgacaatttggaaagctggaacgtggatttttgaaacgtatgtaaaacgacaggttagaccgcttacacactcttcggtctctggaaaatctgttactaccgaacaataatcacgcgtcaggctgacataatcctcgtacctttggcagcgtcaaatgcctgcctctccgagtcagatagtgcattcagtctcgcctctgtctcttcggggtcgatctcccattccgggacgggatgtggtcccatccccgtatagccgcctcgtccgaaccctcggccacggactccgttggctcgaatgctcccggcgccggtgctgtaacggcccgctgaaggagaagaggtggtgggagaaggagaaggcgagcctgtgagccagccagctttctggccacaggagcgtatgacggatgcgaacggaatgatgagggctatcgagaggatcacaagcacgagccaattcacgtcgtcgtcttcatccgacccaggcgacgggaaggtgggctgtgggtcgaaggtgagaaacagaggcggagaagaaggatgggaggaagggggagggtaccgatatctgcctacagaagacggttctggagaccagagtggtacagacgacttctcgacaagcaaggacgcgggggttctagaagggtcagcgtagagcggtttctgatgtggatgttggactagacgcttgtgctcccgtgctaggttgtgctcgtcgaggtcttcttgtgagtcttgttgttgttgctgctgtggttgctgttcttgttgttgctgttgatgataaaggtgagaagacaaaagtgggctagtccgctgctgggctgtcgtgtcttttgggggtggactgtgcaagtcttgtggagggactagttgttcggggagttgttcttgggggtcttggttctgtagccggttcaagggtcgcctccgagagtgcaggtgctcaggtgcagccgaggaggcagaagagggggagagagagttcgacatggcctcacagttgggccagaaccacaattaaggaggacagacgacgacggaagaggggtgtgcaaaagtccgtggtgtgctgtgtaataagacaattcgctttagggagcgcggatcgcgtacaggcgagcacaaggcagtgcgagtctgagcgagattgagagcgagagagagataggagcacgcggacgaccaagggttgttgttgttgtccagggtagacaggtgttgttgacaatgaggaaaggaaaggacggtacagatgtatgcaatgtgtcagcagcgcgtgtttacaaggggtgtgcggtgatgaatcatcacaacatcgggggagacaggacggatgagctccttgtgtgtgtgtgtgttggccagaaagggccaatgggttaatggcgagctgtgtgggtgatgaagagtcgagggggagatcagaaggaagggtatgtgaggtgtgcagtgcgccttctttggcgtcgttccttttgctttgttccttgtgttcttgctgctcgataatcgtgcatcccagcaggccactgcagacatgaaagtaacgctcctgtattcgataccttggtcgttgcagtcattgcgccctggaggaccctgtagtttatctcaaccgcgtggcgtctgcaggcaacagcatggtatccgagctggcagcggacagctggcagagccacgtggggacccaaggtttgcctgagtgattatgtcacagaatatctcgatatcgcgcgtgctgtggcttcttttattcaaccgaaatttctgagggcaaaagatctttcacttttgtgacatgtaagttgggaaccctacggatccgatcagcgcagcctcagcaagcacagcagcaggatgcaaagcaaaggacagaaaggagctcatcagcatcgtacgcaagtcatcatgtcgatcagcaccaagatggataaagcctgctgccatgtcatagcagggatttgtgattcatcgcaattgctcatccgcaccatttggatttggattccaattcgcaggatttcaagggatttgatattctgtcggatcaaggtcattgtactcatcgcccgaaccctgcgtcttttttcttctcatccacagcgaggacgtctaccccatatcaaacaataatcaaaatgtctgcagaaagagatgccgctattgaggttgccgaggtcgaggtcgctgccgatgcctctgcccgtggtcagatgtccgttgaggaggccctccaggaggtcttgaagcgtgccctcgtccacgatggtcttgctcgcggtctccgtgagtgcgccaaggctcttgacaggtaagagacccgggatgactcttgcatgtgtttgtgttgcattttgcagcccgttcaatcgccacagtattaggtaactgatcgattgtttcgcttctgctttgctttgatagacgtcaggcccatatggccgttctcgtcgagacctgcactgagaaggagtacatcaagctggtcgaggctctctgcgccgagcacaacatcaacctgatcaaggtctcggatgccaagaagctcggagagtgggccggtctctgcaagattgaccgcgagggcaacgcccgcaaggtcgtcggctgctcgtgcgttgtcgtcaaggatttcggcgaggagtctgaggccatgaacgtcctcttggagtacttcaagacccgttaagagtggctcagtcattccttgcctcgtttttgtcgttttttattttcgggctgcttattttttgcttattcatttgatgttcttggaggaggatggttcggtgccagtgagggagggacttgagcaagttgtgcaggatgctgtgtgcgatggttcggagcacgagagcgcggcggatgattgtctacggccccacttgcgcgcgggatggagatcgactcgacgatatcccagcggagggcggggcacagtgcacagtgcacacttacccccgtttcaaccgaggcgcaaaaatagcatctgccagacgctgttggcccactctgtttccagtcgaacccttcttttgggacagcacgaattccaaaggctaagcagccaaaaataaatataaagcacgagcaaacaacctctctccacaccccgtctgtctgtctgctgtctgctgtctgtctgtctgctgtccgctgtctgctgtctactgtctgctgtctgctgctacactgtcgactggcactaggagtggaaatcactctccctgattcacactctaccgcactctgcattcggatcacatcccttctccacatcatcacgctgctgctctcatccaccctgcttgcactctttgtactaacacgacaaagagcatagagagacacaggcgaacgagaaagcgagagcgacagaacgggaggcgtgtgtgtctgcctgcattgcacggtgcatcatccagtgttccatccccaaacggcgctctcgtctattgatcccctgtttaaacccctagccgccgaaccttgtgcgccagccagtgccctcacgcctgctgctcacacactcgctctgcactcccatcactctatcacttcacctgtccacctaccgcctgtacactggtgcacttccttgacaacatatcgcaacccgcactgcgctataaaacgtgccttcgccgctccttctcactcgccttctctgtccacctaccgccctaccacctacctcatatccacctttcacctaccacatacagcccacctgtctttcgttgaccccatctccacatatcgtctccctaataaccgactagttggcctttcatcagctaccaagaaacctcccacggttatggtgctctcggagcgcaagaaggtcatggccctgctgtcccggcggcagaccctcgagaacgacctcgccatcactccagtcagcgcggatgccaagcaagggctcgacgacatgatccccgatctgctcagatatttcaaatgcgacaccgtcgaggccctgcgcgcccagtaccccaccaccgcggacatgcgcgccgtcgccgaaacgactcgctactttgcctcgcgcaaggcggcccaagatcgtgtcggcgacaccttcgacaacatctacaacgacattcgaaaggcggacgagaaagaatatgtggactttgtgcgcatgtccaagaccgcgttcaacaacctggtcacctcggttctgccccagcatcccgtcttcaagaatcagtccaataacggtcaggaatcgatagagaagcagctcgcaatcacgctctggcgaatgggtcactttggcaaggacgccggcgtcgcagaggcgagcaagatctttgggctgtcagaggggaccatcgtcaaatgtacgcagcgctgtttggaagccttcaaggacattgcgtcggatgttatttcgtggccaagtcagggcgagaaacaaatcatcaaagggcggatcaactacatcacagcagcagatccttctgctccagtgctggagaaggcagccgcagaatcatcgcacgagtccgatagtgacgagtacaggacaaggatcaggggaaaccgaggtggtatctcggatgctgtgggaattttgatgcggatatatatccctctggccacgcggccactaatgaaggatccctccgagtttatgatccccatcccgccctccttgacacgtttggtcgcaaaagcgcatgcgcccgcggctccatcagattcagaccatgcgaccgcgccctcggaagaagagcaggaatcagggtctgcaccttccagaaaacggcagaaaaggcctttgaggagaaaggctatctcaactaaacgaggtgcggacaaaatcacagccgcgtccgcgaggttaaagcgtgcggcaaagggcaaacagaaagccatagacacaccgccaccgccttccgatccgacctggtcatcgactgaactcaatggagaatctactgaacaagcgcgtcgttcaccgttatcgggggcatccgtcgtcagctcgcccaccgcctccagctatctgaagcgggactatggcttcaattgtctcctggtgtgcgaccctacaacacggatacgattcgcggacaaattgcagccaggttcctgggacgggcgacgtgtgctcgagagcagtggacttatagaaaacgaggctacgctttttgagcacaacgactacttggtcgctgtggacagtgatcttccaccttgcaaaactatcatccctccttactcagatgcggatctcttgggcatggtcacggacaatgacggcatgcgtctacccttcttgccccaggaggaaatcgccgcgcgtttgaccttcaacgactccttgggcactgtcaggaagcgcgcccaggattgcgaacggatgctcaaggccaggtttccaagtttgctggggctgaggatacaactgaaggatgatcctgcaacggcggaattcacgcggtcttggctgcaggcgtgcgtgacgatccataacctggtccttggagatgactcgagctatggccaggaatgggatagccaactagaggatcttgagagcaatgttcgaaagctgcaggagcgacaggcactgctgttgtggaggagggaatccaagcccagaaagaggagaagggagaatcagagtggaaagtcggacgtagtggataatgacaacgatgaaagcaatggcctcgacagattggaagagacgggcttaggagatccttgcatgaactgaccttcccccctcccccttccccatcgcccctggttttgcgagaggaaaaaacaagatatgtcctagaatccttttgcgattctcggtccttggagcacaagcagaggctcgctgcgatcgttcgactatgaatcggaaacttccttcatttttttttagctgtatggctctacattctaattttattaaaaaaaaaaaagaagaccgacatatattcgcttggtgtgcatgggtatgatgacaaagcctttgacgacttgatttttctttgtttagttgtagaaggaactgcccacgcctagaggatgggcattcatccagtcctgaacggcctcacttccatcccagtcactgttcccatggcccacccacagtctgtgtgagaacaacccctcgatggtctccagctttggccagttcacatgcatccactccagctctgcaacatcaatacggtgcgccatcctcgtcacgtccagaatcctcagttctttcagctcgctcatcaagcctaacccactgacgagcgagagttccaagcactggtactgatgttcccgaacgagcgcaccaagcgttggatgaagccgtacgagccgctctgccatttcgatgacaccattgggattgacatccggacgaccgagcacgagcgtttgcagctgggtcatggcacccaattgtttgtaaacactctcttgaacctggagacagtggctgggagtcacttcaggaagtggatgcggaaacggcctgcccatgtgatcacacttgacatcgggtcgggggacgccatggataacaagtcgtagatgtttcaaagaagtagttcctgcccatgtagcattggaatgcatgatatcctgagcgcggagaactatctctgccacacgcccatcgcatgtcgcatggacaacgaaatgcccgttcaggttctcgagaccgggcgctgaacacaacagggtttggatgtcagaactcgagagcgaaccccacccgttagcgcccagttgtgttagcgcactggcgtgacgcagtagggcttgaattgacagaggtccaaagtttctcatgaacggtaattgaatcgatttccagccagttcccctgccgccatcttgacgatcgctgctgctgctgctcgcgtcgagcagatgcgcaatctcggcatcgccctcgacgcagttttcggattcccacttgaggcggctcaacagcgggcagtgcttccgtaagactactgagagttggtcatagggcacatccgagacagagcgtaggatcagggattccaagcgggggcacctctccaggaacgcaaacaaggcatctatgctctcgatgcgtccagagagagccagttccttgagtgcatagggtctgttgtcctcttggtcatcgccttcttcaccgtcctgaaacacagcagggtcaatgtcgtccgcgggggacttggatgtcagaaagctcttgcacttgatgtcgagtcgatcgagggactgggttggcagactcctcaagatatagtccagggtccgacacccagcccttgggtgaaagataaagccttcgatcttgacatgctgaaggcctcggttctgctttaacaggatgggcagcgcgctgctgacgtagatggcctgccttgcaaaggaggcctccacgtcccttggcggaagggtgacgagttcagacgagacgctgagggcgttgtggtctcggaccagggtcaaggacctgaggtttcggcagcgggtggtcatggaagccagggcccagatccacttgatgttgcaggtgtggagtgtttggatggagtgacagtttcgaagcaaggccttgagagtgtcatgggtgttgaatttgttgtagtcgatgcggtcgcggatctcgatggttttccacagctggggtagaaacaagtcagaccaggagcgattgacgcgcacgcagtgagctaggtcgctggtgtagagactggaggtgattatctcaaagacctcttgtgggagcttggagatgacggggggagtgtgatccgccattgcagctattctctttttctttttgtacggtaagcgtttgtgtgggatgtgctgtgtgtgataatgcaaggtaggcagacttctagcgaaagtgtgcattgggccgagtaggtcattatatagttctcaattgtggtctttgggggcgagaaagccattgcgtgacaaataatccacggcttgagcctcgatccatgttccaaggctgctccaagcacgatctatgttccaaggttacgatcagcggttgcgtcgataacaaaatgccaggtatgcagatactcatctttcagaaagcaaaactcgtctttgtggaatggagtttttttatatcagtttattcttttgaatgaaagaggtaacatccgttctattctttgcggtaaaagtgcatatgctcggaggaggaatgaatgagagaagggctagcatttggccattaggacttgtgtagaaatcctagaactttgcccactccaactgagaaagccgggcggcttccctctcggtcacaagcagcaagtattgaatcaaccccagttttcggaggcggatccagtgcaacaactggctgaagtcttcctgacattgaactcggatattttcagaaaccccgttgttggtggagagctgctgaagttgcacgccaacgccttccagttgctgtatgctgcaccgcaggatgtcaagcagggcagagtgctcgaggtattcttcatccatgtcttttgtgcacatcgaagaaggctttcagagttgaggataatgggttctgaaagaagagaagggtggtaaacggttcgtctctgcctatgggccacttgaggtttcttttaaatggttgccacaagcacagtcaaaaaatgccacagctaaaacaattcaccagctctgcgacatacggacatgctcgagcgatgaaagagctacccgcatgtgcgcatgagtcgttgtccatgtgcacgtaccactctcttatagtgtgtcacatctcccgtgccccacgccagatagcccaggttcgttgactatctttttcgcaggcttatgggggcacatctcactatggtgtcgcgtacagtttgggtgcttttggggccgacgcgcgttgatcgctactcctgcttgcagcatagtcatatgagtgtcctcaacggccacgccatggcctccgtctccctctcaaatcaagcgacacgttcagcccctgactttgaccaagcggcttggaatggctgcgcctttctatctggctgttttgtttcttcgcctccccaatcccccgcacgcattttccaaaataccattacgaaccatctttgaatacccagagatgtgccataccgtcgccggctttctcggttaccacgactactctgttttagccagggtcaacaaggcgttttacagtgctttcttcccttatcttatgcggtccgtcgtcattgccaacaccttcaagtactttatccacgtagagagtctctactctgactttacgaaccggcaaaagctccctcctccaaagatcttgttcaaatacggtcagcatgtgtatcacctccaccttcacttcaaggagacgatcgacttttgctattttgtcaaggaggactccgataccaagcattacagactttcgaccctatcgacctttcctggccagatccagacgaacctttatctgtcgctgttggaaaagtgccccaaccttggatgtcttcagatcagtgtcacacattcggatcgactgcccagcgacatgcccaacgacagtgggctcgaggatgaagcaggcaaacaaaaaagcagagattgtcgatggtgccattgctaggatgatacgagcaatagcagccaagccgctcgtcgtcgagcaatccttgcaaccctctgagatgagtggctctgtattcgacgccccggatcggaaaagtgtttcagggtccagtcatggcctgcgcaagttttttatctccaattccaacagatttgcggagcagtcgatagacgcattgattcagcggcactcccagtctttgagggtactcgagatccgaaactgtgctcgggttggcagcgcggaaatgttgcagctgttgatttgctcccaaagctgagggaggccgagttctttttcgaggacaagatccgatacagacacgggctcaaagagacgatggaggatgcagacaaggctgagcaggcgatggccgatgatcaggacgaggatgacacgtcgagccaggagtctggggaaaacagctcggggagtggtcgtgccagaccaccactgggaccgctggtaggcccgtgcatgttttcatgcaccgatagtctgacgtacctgcgggtacccgtcatgagtgtgacagtgtgggagacgcttcagcatccgagcaccaaggacatctacagctggttctttgatgcgattggaacactgacgcggcttcaggaactgcatgtccagagtattgagcccaaggagcatggtgtggctgtggtgccgttccagctgacggtcgactcggggatctggcgtcggaagggtctgggagagttggaagtgtttggttttgaaaaggtgaagcgtcatagggtagggcctcctgagattaactggatgaggatgcacaggccttgattgagggagctggtgggactggattacgaccagcatcatccgaaaaacattgagtgtgaattgctaatgagggccgctgtgccagagatcaaggtgccagggcctaccgtgaggacacggttgcacttgagcgagagacactgcagaagtctggagacccaaaggtgaatctcgctataaagtgttctgtgaacacgaaaaaaaaggccccataaaccgtgtttttccccggatcgcaaccccttttcaccggcgggtattgaattaagagtcgtttcgaactctactttacaaccataaatgaccttaatgtccatcatgcgcgtcctcgatctgcggcgcgtcttgattactgtcacctataccgccaggcgggtcattcgtgtgcccgccaagactgtcctagggcggacggcgtgtcgggatggagccttgcccttgtcactttatgtgccctggcatttgcgtgagtgcacttaggatctagaattacgttgagccgacttcccttcaaacatccgtccccttccaagctttgaaggggggagccccttccatcttttgctgctaatcttccattgactctgactctgctctcatccctgtccttccgctgcctttctgcccttgttctgccccttctactttcaacacggtcctcgcggggtcgaaaacaatagaaaatagtgcagcgacactctccacaagtgcagttctttctgaactactacttcttactttacctccctcctcttgtcaaggtcatccattgctgattttttttttccttattgagcggccatccaaccctcctataggcaccttcccgcaccatgcgctttatcacctctattttcgcccccggcttaaccgccgtatcagccctgctactggcgctccaggggtaagcctttgtcttctggtccgttgcaaaactgtattcttcttgacttcacaagcgagagattattgcaaatttactcgttagaccctcgtctgatgtgctatcttagcgaggcaggccctatagcggtaaaagcagacgcatcggggtctctccctctcttgggccagttccatgtttatgtcgattttgaggagctggcgaaccctcccaggcagtggcagtacctagagcccgcaccatccagtgacaccatcagccttcgtatcggcctcaagctgcaaaatgttgagcgcttccaacaaatggtcatcgacctcagcacgcctggacacccaacttatggtcaacacatgactcaagacgagatcaacggcattatcagcccgtcgaaagaaagcgcccgacttgtgcttgagtggctcaagtcgtccggtatcgacgcggtccatgacggccaatcggtcaaggccgagatcacgattgctcaggctcaggtgctgctacaaacacgattcaatgtctatctcaacaccctcagcagcaaaaaagcgatccgcacgctatcttaccgccttcccgaaattctcaaaacccatatcgaccttgtccaacccacaactatgtttggccttgagccgttgatcccgcgcgccagcccagagaatctaaaacgtcgcgccgacccaggtgtgaaagaaagcgaaccctccctcactgggtgcgataatcgcgtgaccccacaatgcctcaggcaactgtacaacatgaagacattcagctccgacagactaggcaatgcgtccattgccgtggcgggatttttgggcgagtatggaaatagtgccgacttgcaaacgttcttcaaaggttttcgacccgattttctcggaatgagttacagtactatcaaactccttggagggcttgacgatcaatccatccccggagttgaagcgaatctggatattcagtatgctgcagtgctagcaaatccagaggcagtgacgtactattcggttggtgaagtgaagccagaattcacaccggacaacaacacccccaccaacacaaacgagccatacaaagagtttttggaggtatttcttgctgcatccaacattcctactacgcttagtatatcgtacgccgactacgagcaaacagttccgaaaagctacgccgagagggtctgcaatctatttgcacagcttggagccaggggtacgactgtattagttgcgtctggtgattacggagtgggtggcaattcctcggctgcgtcatgcctcactaacgacggtaggaaagcgaacagattcctgccactctttcctgcgagttgcccatttgtcactaccgtgggcgggaccgttggcatggcacccgagagcgccgtcgcattctctggaggaggcttctcggaatatttcgagcaaccagtctatcagcagagcaacgtttcaacgtacttgagcaacttcggtcccaagtatagtggtcttttcacccctactggccgtgcttatcctgatgtcgccgcgcagggagatcatttccagattgttgtcaacggcacagttcaatccatcggcggtacaagcgccagcaccccagtctttgcagctattgtctggaatgtcaacaaccaacgcgaatctcaaggcaaaccgcctttggggttcttgaacccatttctgtacagcaatccacaagtattgaacgatatcgtgttgggcaacaatcctggatgcggtactcaggggttcagtgccactgcaggctgggatcctgttactggattaggaactcccgatttgagcaagttgatggccgctcttgcttcatggaaatgagcaatgcattcttgagtctgttctcttgcatacaaaaagtgaatatattaataccctccctgaatcgcgagcacggctttcgcaaggatgccggagctggagtatcagcatggttttatatcacacaagagcatacacttcatgttccaccttgtacgaagtatgttcacgtcggacgatgattcaaacatgtcccgcctgctgagagttatcatacttccgtgctgttaacgactagcgagtgtaatcgagagctggttgagagatgaatgcgcgctagttcaacgcgaacgcgggatatctcctaccatggctacgcgatgttgatgacggtcctttggccttagctgccgaagctggcagaatcgggctgaatgagaataaaaagaataaaagttgtgaacagtcgcaatacccagcaacaatactcagcaacctgctgcaagtcggacctcgctcgagaaagcggtggagcggtggcacttgcatgacagataccatacatcatgtattcctagaaacctagacgtcgctcctcctgcgaaaaaagatcatcaccaattggctcgctattgtccccaaaaatagtgtttctcgcgcctttgcataaagtagacctatggtgcctggcgtatattttctactggagtaccgtacagtccactataaatcctgatgtaaaggtactaattacagtgacggagtatctggcaaaccggcacactcttgaaatagctggcaacattcctcgctcttgctcaagcgcgaatcgcgtgcttcagaggtgagtttctgacgcccaagcacgtacctcgtatacctacagctaaggactacaattatcaaactgtgccgaggtaaaagggtgcgccgttccctcgagctcggcccgttctatttctcgaatcctaccctgcccgatccctacgcttcgatgggtataaaatggccaccacgttcttgttatttctcgtttcaattctccccacctgcttttcatcattctctcaccttttctgtaagccctctaaccatgcgcttcttttcgatcagttccacccatggcttgattgccattgcagtcttgtcgatggctcctcagaggtaacctcagtgcctttgtcaggatgagcaaacgtcgttacaaatttacaaaatgaagacacgaactcaatcgcatacgccccccttgtctttgcgcgacgttagagaagcgatgccagtctcagcaaaagcaggcttatcgagtcagttcaagtcctacgccgcctttgaaaagctggcaggcccacccaagcaatggcattatcaagagccagcgcctacggggtccaagatcaaccttcgtatcggtctcaagctcaaaaatgttgagcgatttcaccaaaaggtcatcgatctcagcacgcctggccacccaacttatggccaacacatgactcaagacgagatcaatgccattatcaatccctcgaaaaaaagcgctcagcttgtgcttgaatggctcgagtcgtccggtatccacgcagtatacgacaaccagtgggtcaaggccgatgtcacggtcgctcaggctcagagcttgctccaaacaaagtttggagtctatcaaaacagcggaagcaggagatcagctatccgcactttatcttaccgtcttaccgtcttccgtagactctacatgatcacatcgaccttgttcaacccacaaccatctttggctttgaagcgttggacccgcgcactcgcatctatcagtcaaaaaccgcaaggagtcgaatgagagtgagaacgactctcttctcgaggagtgcaaagacaacgtaaccccccggtgtctcatggacttgtacaacatcaaggctgttgacctccgcgacaattaccatacagccatcggaatagcaggatttttgaacgaatatggaaacagagctgacttgcaagcgttcctcgaacgctcccagcccaatttcgtgggtagaaattacactacgatcttggtcaatgaggggcttgatgatcaatccaaacccggaggtgaagccaacctggttattcagtacatcgcaggactcacgattccagacgcagtaacgtactactcggttggcggaagtccgccctacataccggacttgcttacgcccaataacacgaatgagccctatgaagagtttctggaatatctcctcaatccagaccagacgaccaagatcccggaagtgattagcatatcctatggtgacaaggagcaaacagttccgaagaactatgccgagagggtctgcaaccaatttgcacagcttggagctagaggcacgactgtattagtttcatctggtgatgatggagtaggggatagcagcttggatcccttcgatcacaaatgcttttctaacgatggcaaaaatacgacaaggtttcagcctgaatttccagcgggttgcccgtttgtcaccaccgtcagtgcaacggtgggtacatcgcatgagacaggagtcttgttttctggtggaggcttttcggagtatttcaagcaactagcctggcaaagtgacaagattcaagcctacttgactggagcaccagaaacctatgaaggcctttataatcctgaaggccgtgcttagccagacgtcgcagctcaaggtgtaggcttcaaggatatcttcaaggggctgcccaatatcgactctggtacaagtgccagcgcccccgttttcgccgccgttgttggcatatcaacaacgcacgcttttctcgcggcaagccgcccttaggttttttaaacccgatgctctatgccaatccacaagcattgaatgatatcatatcaggcaacaatcctggatgtggtactgagtgactcaacgcgactgtcggctggggtgccgtaacaggtctggggacgcccgatctaaacaagcttattgccgccctaggttaactgagatcaggacgcctgtgacttctgcttgaataataagcgctctttacatcataatgaactgcgaaggaggcttttggcgagacttccatgagcagcccaacagtgtcatagaccatgacagaagtgcagtgtaacatgctatgcgaaaaaggaattactgtaaaaaacgagttatgaaacggtatcacgcatggctttttttttcaaaattatcctcactctctcacactcattccgtgcccctcttcagaagcaccatctcaccgcggtagtaaagagatataataccgttaaagtagtccttgaggacttttgtcctcaaacgattcgctaaatgtaggttaagagagtcaggatcattcttggatacatcctcagcactgagaaattgcaccatacatgtattctgagtagatgcctaaggcctagatcgtcgctcatctcagagagcgaacttgtagaattgtggtcatacgtaatcagtgccttgggtgggcacaacctggctctcaggtcgtacgtcttcgaaacctggctttggcatcactggacgatgcatgttatgttgtcggaaatgcatttgaggttaaccatgccggctgaatgttgttagaggagaataagtgtcgaaggccacaaagtggcagagtatgctcttaacggaagagctatgcacagagatggacgatgccaaatatggcagaatgctggacctgcaatgtacgagaggcaggtatgagctcaacaacagtagttcaaggccgcgggcgtggggagcactcaggtcaaacttcagtaaggaaaaccctccgtgtcaaccaaacgatgctcctcttgctcaatgagcaaaccaggttgccactggaacaaatggaagcgatggccttggacgtacacggtaacgccattgcaactgcttatttggaacatgcgaatgtgtggagctttgtattcaacactgattcgtcatttgagccacgaaacacttgcgcgtttttactggccggaccgttgtcagtacttttaaagtacacggtaagtgagtgccggtgcaatgcatcatgtacggtgttgttaatacaatgctacgcactattcacgccctctggaataaaccatgccctcagggataccctcctggattaggcaaccaggtgcaggaacaagcttgatacatcaggaacaacagatgctactggccggttgtaagacgccaccgaagcgggagcggagcatcggtgacttcaccttcttatcgcccactaatatcaaaaagacgtccttgtgaacttcccgagggcagcgtataaggcctctgaaatgaagtgggcccggaaatgcagcggtcgccgtctagcgcatacttctgatagtgcccaggccctagctaataaaggagcatgtgaacgtgtaggtcgaaaaaaaaaagaaagcgcccaccgtacgaatagaaaataggcatgggaacgtgctagtgctagagtagcggatgggacagaaagagaaatgcacagtgcatgaacagagggaggaggaccatgggtccgtgcctaaccgtgggtagcgaaataaaaaaaaaaaaaggaaaaaagatgacatgaaaaatgttcatacgaacatgcaaaggcaagggcaacgcagcgcacgacttaagagaaaggtatggtgacatcaaggcgcgagttgcgacataaagtaaaaacaaaccatacgccaagctagcgcaacatgaaaaaaagacgagaaaatgggcgtcggcgtgggtcacgttgcatgtacaaagcgcataaacaacggacaggggcatagggccgtgccagcgcgtgggtagcgaaaggaaagctggcgcatgattagggaaagaaaactaagaaagacatggggcatggaatcgggcaagggcgtgggtagtgtacgaaaaaaagaaaatgaagtcataacatagagaagggacagagccagggcgtgggaatgaaagagtggcagaaggcaggcaaaaggacaatcccacactacttgagattgaatcagcttcatgttctgatcttgcaacagtaacccccccccatccgcgatccctcagccctcttgatctcttggactatagtaccgtgggactgatgtttgcactctagaaagctcgttcagactcctgcgcataaggagtgatgtgattcagggtgtgcatgatgtaattcaagcacgagatagtgctttgaccgcactcgacattgtaatgcagaacgaacatgctatgagcatgagcagtataagtacctcgtcactcgtcactgccgcccatctcttttctttcactactcctctcgaatactctgatccaaaagtccttcctcttcttttccaaagcacatatcctatacgctttatctctactcacaatgggaaaactcatcgttgacgttctctctgcgagaaatcttaagcatgaggatggccttcttggaaaaaacgacccttatctcgagctcaaaattggccatcttctgagcgctcagaagcacaagaccaaaacccacaagaatgctggtggtagtgttaatttcgaccagactttcgaatttactgccgagcccaacgatgacctgaaagtcgcgctgtatgatgatgatctgattcatggtgagttctcacctttcgcactgattctatttggaactgtgtggtcagccataattgtggaagcctaacactgtgcctgcttgcttcttgtatgatacagatgatgaagccgggcacgccaagattccgctacaaggagtattcgagaccggcgaggtggagcaatggtacactcttggcgaaggatcccatgtccgcggtgaagttttgttgcgactgagaacactctgattgacacagacccggatatcaatttacatgtccctgtggcttcaaaactctgctgaagaacatgaagcaactcaaggagctagaacgtctagatgaccttgaaggaaataaacggacgctgtggtggttagtgtcaaagaatttttcacttgcctaaactgagggtcgactctggtaacattctgattgtgtttgtggctatagaacattccctgcaaaaatgccgtgcttgcagtaagcggtcagtgcaaaaaaaaaaaaaaaaaaaaaaaaatgaaagatgttctcactcaacctcctttatcttttctcgagtgcatgactgaacttggcagttgttcagaacctttcgcacttgcacaacagcattcatgatttgcctatgtctccttcgatatcattgctttcaggaatttgcactgtttccctgtctcttttcattattcagcacccaggtccaccctcattctctttcacacattgcagtggacaagactcgatttttgaataccaaacgcgaaagaagagaagtcgcatctcgatcaacccttcgtgctgggaatgttgtacagctccgctaagtggggggagagggtgtttgcgatgatccgcgcgctattatatgctgaacgtgccaaattttggtgtccctttcacattgatgcttgactaacaaactgtatttgggcttgggtgtacccagggtgtgccttgggctctgtgcgctgttgaaacagtgcactccaaaattcaacctgtctagcacgcatcctcttcagaccgcaggcgtcatgactttagtaaactctatcgagagacccatcacctccatttgaagtccggagacccgcttatcatcgtcaagggtgaatgttgccagcggtgtcatttgaacgtaaaagtcggccagttcagtcttgaacgagtcacggtggtagtgctccatcttgccatccatgacgttgtacttgaagtataaggatcccgactcgagatgcacaaagccctcgccatagacgggattagtataagtgccaacatactccttcaggttatgtgatggggaagtgcccttgacttgctcggggaaatcgccgtcgcgcacgaatttcaactggtggtatagtgtctgagcacccctgtcagagacagcaagccagtcctgggtcttgggcaggccaaagagttcgtcgacgatataaaacggcacgtgagtgaggagctcggcgactttgacgtttgctgtgtgggcgataacaaggtcatcatctgggaacactaacagatttgacctatacccaaagacgctcccggctagtcaaacgacaccatcatcaaaaaaaaaaaaaaaaaaaaaaaatcagattattgcagacggactataatctgataaacaaactgcaggttcgcgactggatatcgttattccatgatatccttaccatgaccaaagaagttcttgcccttgtaactgtccggaatccagcccatcccataagcctgaacgggcgcgaattcgggcgtgcgcctcgatcctgtcatgaatgtatatccaaccaccaactgatcgacactcgttttgttcagcacttgcttcccatcagccaggcctgactgcatgatgacccgtccccagcggactagatcgagcacattggagtaaatatcgcctgagggggcctcggacagatagatcggatcgaggtagcctgtgataaattgacccctcttggcatcctcgtaggagtcagcattataaggaatcgcataattctcgaaccgcttgcccatctcgacaggcccaaacccagtgtgatcaagtccgagaggcttgagaatcttttcctcgaccagcttctcatatgtggtaccagcaacgttggcagcggcctcaccggcaacagtgtacattacgttgctgtactggaccttcgtgcgcaatttggagtccaacttgacgtgcttgaggcgcttgatgagttcccgacgggtggtgttggttctgtaccaaccgaaatcgaggtttggcatcccctacaatgtcagcgtataactgtaatgagttttttttttgcttctcggttggctaccatttttgaaagtgccgtagatcagcgaatgctggagagatatcttaccgcacggtgggacagaaggtcgacattagtcaactgcgatgtaagcacgggatcttcaagttcaaattcaggcagatagtgggcgacaggagtagtgtcccaatccatcttgccctcggcgaccaattcgccgatggcagcggccgtgaaggccttggtcaaggaacccacgggctgcacggtctagggatatcaaaggtgcatgacgtaaaaaggagtagattgtcagtgagccgagctgcaggcagctttaggaggtctctgctaataagaaaataaagttttggtgacggcgacttggtccaccatggtactacgacctacctcgacggtgtaagggtcgttggcgtttcttttaccgaaaccctctgcaaagatgagcttgcccttgtacaaaatagcaacacccatcccaggaagtcctgttgcgtttcgagccttctcgagaacgtccttgagatccgaaagcgggaccttggcggcttgagaggggcaggcgatctgggcaagtagtatggaaagaaggatgaagagaaaatagctagcggttgcccgggatgaggagaaggcgaccatgatggtgtttaaaggcaggaaagatgaggaggtttacagtgttgacagaaaaaagtatcgtggatgcgtttcgacttttatacgctccgaaacttggtgggctggtgggacgcggttccttagacgctagtagggctttacttcgagacctgttgctcgtgcagtagtggtaagtattcagtaaagagccccggctgtgaattaacagctatacgatgcagatatggtctgcccaccattcccatttgctactgcagtcatcgcgtagcacaatggcttttgcaggcaagatttgttcagcttttcttggcacttccatcattctctcgtgcagcacgaaggatgacttcagtgttccagtaacaagagaggcaaggaaaaaaaagactggacgaaagcttctttgtcaataagtgctcgagatagacaagcatccatgtggatctttcataaatctccagagcctaagggaactaaagcgttgactgtaccttgcattccggaacaaaaaaactgttgaatgatgggctgcacgtttttatgtcgtacagaatttcatttatttttagattgcggcgcgtctgcgcatccaaaattcgtcatgggagcaacgtcgggggtacgacgacttccgctccacagccagctgcttgtgcaacagtgtgatacttcgctgtgacggaccgcgtccttggcaccatttttagagcatatatggctttcatgtatgctaaacaaatgcacttctattccaagtccatgcctccacgactgctctctatagctgttgactggtaacagtttttcgagcgatctgtttaggcttgagttgccacgctgatggttcgtgtgttgacagactctcgttggaggacgaaggtcctttgagtttgctataaagcagtttctttttggttgctattggtcgatcttacaacaacactaggtcgtgctcctgtttgaaaacacgacgagtatctagctttggatgctgatctgtactctaggacagtatgatcacggtcaaaaaggtttaatccccctccccatcatggtctaccgcgtgggccgccttttatggccagaggagatttgcgcaggtgcctcaatccaggagagaaacaaaatgggattgctaaaaattctgtcagcggaacagagcccttaccttttcctaagcatttgattggctgtacagctatagaagccgctgttacctctcaatcctccaaccgtggacggcctcggatctctgaatcttttccccatcctttcacgaaaatagaccatcgatggcgtctggatttatccagtggaaaaaggcagagtataggtgctgttgttcagactcgtcactgagtgtctgagattgcacggctcaatcagtctggtgacgctcaacctggtcactattatcggctttcctgaggctggaagccatgtcaaagtctaccgagtccctcatttgcgctgcaaatccgttcaaagttgatagattggacatggctaggagtatgaattgaaatcgaggatgttcttggtcgtatcaagttaggacattgtccaagccttgcgctgcttgtgtcaacaacagctacctagtccttacggatcatggcccctcattcagatctgtcaaattcaggctcttgctccgttataggagggttgtagaaggcgatattgatagctaccctgttattcatcttgttcatcccgaatgaccacataaagggactttgaagtgccaccctccatagcgtctacaggcaaggaagaaagataccgagttctgcgagctttattgttgcaatctattttggccaacgctcaagggggaagagagaggcggggggcaggtggacagagatgccatcaacagctgatcttcttgacgcgctggcccaactgtctgaatatcagtagtatgtaacactgaggagagtggggcgacgaaacgtccagcaaagcggagcagacggggacgggaacacgaaccgctaggactgaaagccagatgttgttgttcagttgcagcagtatcgctggatcagcagggccaggccttttgtcagcaacggcttggtcatgtactcgtccatcccagcttttatgcacgactgcggtcgacaacaacatcaacagaaaaaaaaatgtcaagtcttgtgaggaaaaatgaagaaccccccgagagcaatcagagttcctcgcacagcccatacacacatcgcggacctacctctttagtcgtctgctggatatcggcgctcagacctacaatggggatccgcatgttccttccggcttcatctttatgttcctgagcaaactcggcctctagagcgcgaacttttttggtcgctgccagtccatccataatcggcatgtgctagttgtaacaaaacataatttcggacacaacagacttgagtgagcgaaacaagcaatctcaatcgagagctcaggccctgcgatacggaggagtgaaaaccgacacctacatggtcaaagatggcaatcgtgtagtgtccacgatcggccgacagccactggttgaccgcctcttgtccattgttcgcgatcatcacattcatgcccaattttgaaagttgcctaaaagatcgtcgtcatatcgcagtaccattagtacactgttatcacgaaaaacatactcctcggcttccaacaaaaaaaagaataagaacacttacttctcaagcaatcgctgcgacacaaagtcatcctcggccacgaggacattcttcccgcgacagctattccgctccgctgagctcaacagagacgtcaaagcatcattattccgcgcacgcttcggcatggtctcctgtctcgccttcctgggtgtgcctgctgaaataccagccccactgagaccaaggttcctcgagacctcatggacgcccacaaggtgtgtctcgaagtgcggtacagttgagtccttgctgaccttgacccggcgattttcctctccatcatcctctctatcgtccagcggaccttgctcccgccgccgcttcataggcacggaagagtcggccgaacagcaggatgaagtcgagaacacctcgctttcagtatcctgccccgcattcgcctcatccgcctctgacatgtccatatctttagcctccatctcggcatcctcctccagcacctccgctcgttgaggttgcatatgccggttcatggcgttgtagatgatctgaagtatcttcatcctccgcactggtttgatcagccggaagatctggaagctggtcgtctccatccgagggcgacacacggcctcatgcctctgccctttttgctgcaaatccacttcactttccgagttacccccagtgatcgtgcaaggcaccggtcgagtgacagtgatctgtccgcgtgacttgcgcttcttgaacaactcggatggctgcttcacgcatggactcacaggcactttggtcttggcggctgcgatcttgaccgccgcggccaccgcggtcgcacggcctgcgagacttgccaaagctgcctggttctgctgagcgctcgtctcatgagaagccctttgaatctgtccgaccgcatgggcctccaaaccaatctcggacgcctgttggaagatgcggccccgcccaccgatgtcaatctgtcccgattccggttcctcgtgctcctccggctggctcttgaccgccggcggcaggatccaccgcaacgtctcggtcgtaggtgcaagaagcaagataaacgccacagtcggggacgggtagatccgatccaactctgcagagtctagaacatggtccacaagaatatagtcgaaccgcgtcattccctcgatgctgcaacacttggcgtccctggtgccacagccagtgccgtttcgttccttcagttcctcgctgctgccgctcgtagcttcaaggctaatgttcctagccgtcgccgtgccatcggcagtttcagtggtgcaagttcctgtcatcttgatcgtgccactttccaaagcagacgccatatcgtcaaactcgacacaaatggcgccctggagagtccgagttatctgttccctcagctgccgattgggcgacaagatcaaaaatcgtcggcccctgatcacgtccagtcgcgcatccaggatccgataacactccaagagccgcgccgactctgcagggctctgctcatgatcatgcggggtcgatgtcctcagtttggctgtaaatgtgaacgtcgctccttgacccttctcagaatccacagtcaccttgccgtgcatgtgcgcaatgagttgtgcacagatcgagagacccagacccgtgccaccatacttgcgcgtggtgccattgtccgtctgctggaacgacacaaacagcatcttttgctcctcgggactcagcccgattccttggtcgctcacagagcagtgcaaaacaatctcgtcccctagctggggatcgtccatttctgccacgacttctgtatccttcttgtgggccttgcccgacaagatccggagtagactttgagtcgaccggggcttcttggacggtcgcttgagggtctcgcgtttgttccgttcatgccaaaactcgatcacgacatttccggacgcagagaatttgatggcgttgccaatcaggttcatgaggatttgcttcagacgatccgggtcgccgatcaggtccaacggcaacgtcggatcgaacaatataatcagctccagtcccttgcgcgaagccagcggtaccaaaagatcacatacatctatgaaggcagaaccaacaaaagcgtgtaagccttgactataaactgaacagacgcgaataaaaataagagagatttcaacaccacctggtagatttcctacctcctacgatctcttcaaagcatagtgggatgtattccagagtaaccttatccgcctccagcttgctgaaattgagcaggtcgtccacgatccggatcaacatctcacaggacgctttggccatatccacaaactcaaactgctcgtgcgacaatccgctcgagtccctgaggagcgacagcattcccaaaattccagagaacggtctagagtgggcgattgagatgcaatgaggcagagtaaggcactgccattctcaacgggtcctaaacgctgaaaaaaatacgaggtattcgctactcaaagttttggtggacgttggcacttacgttcgcagctcatggctcatgttggccagaaagttggacttcagctggactgcacgtcgctggtcatcgatatcgatcgtcactgtgagccactgaataaccctgttgtccgagggagactttatcggcagcatacgaatgatggcccatcggaacgatccatccttcaaccggtatcgactctccctaaagaaggtgcacaggatgaataccaatcagttcttcaagtccaagaaaaaaacaaagcaacgctcttacgtctgaccaaaagtttgctctctctcgagaaacacctaccattgacagggtacgccggcgaggacacgttcacgccaatgatccgcatagatcgcgagctcatcctcatgtgtcaagatctcccatccagaactcataatctcctcgagcgagaaccctgtcatatccttccagctcgaattgatatactgacagttctccgccgtcgcgtcccacagcgcaatcccgcagggcatgttctccagtaatccgttcagcttggtctcggactgaagcacagactggtacagcaacgcgttcgtgatcgagatccccagttgctgaaccagcagattcatcaccagcatccgtttgttcgcaaacgccctttcggggaaatcctccatgtacagcacccccaccatcacagtcttgtgcaggatgggcgcacatagaaccgtccggagatccgcccgctgcttgagataatcatccgcacagaatcgtgggtcgtccatggcattcgtgagcagacacagtgtcgaggtgttgcgcacgtagttgatgacgccatggaacaacgagctgcactgcccgactggctgcggagggttcacggactcgcaccgtcccagattaccctgcgaagctgccagaacgagctcatggttcttggaaataaagatcgagcactgcttcgcacccacgctctggttgagcacgtacagagatttgacgagtaacaagtccaagtcgatctcgctcgcaatcacctgcatggactcgatgaccgacgaaaagtccaagacatccaggtccgcattgtccacttccggtgatcctggtgatgccgcccacgtattctgcagattatgtagtgggcctgaggacgaggcactcgaaccaacattccctgagcctggcaggtgggtcgacatacaagactctgcaatcgcagccgcggcggccgagaccgcatcgttgccgaatccaccaggactgtacatggtcttggggctggctgccagccagggggaggtcgagtggcccgagctggacgatcctgccacagtactgctgaggttcgagctcgcggctcctgtgggacccacaggatgaccagtggtataaggctctgcgtcatttggccggtaaaaaagtccccggcttgagtggactggctccagctcaggtgcggacccaaatatttcggggtaggtcttgtgcagccactggaccttaccgcgcgctccccagtcctggtagcccttgcaggcggctgtcatgaggcatttagcactcgtgacgagaccgtgccggaggtggcatcttgcagccagctcgtacgagaaacacttgtgaagcggaaagtttccctcggtcgcgtaaaagatggccctctcgtagagcagcatcaccttgccaagacaggtcttttgctgctcccacgcttggtccgcaatctcggcctccagaagatgaaacatggctgcatggttggtcgggaaatgtttagcccgctcatccatcctgttgcgtaccacacgcagtcggcttgacagcttctcacgttccacaggattgtgctcggtcctcagcaagttcaccagcgccagccccaccactgtaaagatcgagtgcgagatccaagagccctcaaagttcatcatcgactttgggtcgtcgtgccacgtatccgtgacctcgttgatgaacgcatagtgcccaaacacaaacgcggccacgattttcagcatggagtacgtgctgttgttatggaccatgaccagattcttttcctgtcgacgtccgtggatcctcgcctgtgcatactcattgtcgtcaaagatcgtctctgggctgtcagcaagagtctggcccttcagacacttgatcagttgtgcgatcccctgcatcacctcgacaccgtgggatttgggtccgaactcaatgtgcttggtgatgaggtctatggtcgcgttcatacagtcgcgcaggtgagttcttcctaagagcacccgcatcaccgagacgtggatcatccccgcagtgtggaagagacgatcgcaagtcatttccgcagccatgagcgtttcctccaaggctggtatcgagttggcaatatggtcaccccattgctgaacggtcaggtaaaacaggaacttgacatgatgattatcattgctgactctgcaggcaagtctacacatcccaggtcacatcaaaaatggttagcattcatagtcagtcgacaaaacagctttcagtacaaagaactttctacgaacaagaaaaatgcgtaatagtggcgttgtaaccaaacataccttccgagctcgtacgcattctcgagacagccatgccaggtcgagtgagtaagggcaaaggacaccaacgcgcgtcctgcgtctttgctgataccgtgttcgcacaccagcttcattgactgagcaatgcctaccgccaaaaatggaatgttctgatagtacagagttgcactacacgaaagagcagagacgagagagacgaaaaaggtgagaaatggcggccgacaaattcacaggtcgatgtgcagaacatacaactgagtcccatggttgctaacttacttggcaatattcaaaacttccatcatggtgctgatccgggcattgcggcacatctttgggttcttaacttccagctctttcatatggtccaacagcatcaaatgagttcgatcgtatatatcccgtatctcctcctgtgacgggttgaacgagacctctttggacatgccaagctcctgtagacactggatcgtgatcctggtcgcctgcgccgggttgctgtaagcccagacagacatctcgatttggtgctggtacacccgtgcacggtcaatgagatccgtgatattcgacagaacctcctcgcaaatcttcatggcctgatcgaaattttctcgccagcgctctgcttcaatgcactggaggtgaatcctgagggcctcgagatagagtggggtcttttcggggaccgcctcctcctcaggatcgccgggcttgcgcgtctctggcgattccattgtcatatctcctgaagcgtccgtgcctggaagtgtccagcagtctttcggaaggagcgacagagccgcactccaataagacatggacatatcctgcgcaccgctcttttgcgacttttctcccgctagcgaaagaatcattcgcaccgactgttcgtctaactccggatggcgctcctcgtcgtcctcatccaggactggaacccaaaatggcttttcttcctgatcttcacagccgccagaggcaagcttcttcctgaccaagtccatacactgcagaatatgactcgcagtccgaaactcctgccccggtctcctgaacaagattttggccatctcatagtgcaatcgctccttttcatccgtgcctttgagtagattgagggccaccttgcgcatgattccgtgatggaagcgaagattatcaggcgtggaggtgtacaccagaataccttcccgcaatgcagactgcagccccgccattgccgtactacccttatttgagtccacttctgtggctgccccgggtgcatgatctcgccggtctacttgcgcatggtgattggatccttgtcccgtccatacatatgctgtcgacgccaatagctgaatgtcttgaatcgtaaagattgagccacagatggctgcacagatgatcgtcttcttggtggcacagtccagttcccggaaccgattctccaaaaacgcatactcctcgcctgtcagcttccgaaccacttcggccagggtctcaggacaggactcccactcccaaacacgactgaagcaattaaaaaatatcgtctggttcctgtagagctctagtaccagctgccgtatggtcagccaagacttggaatggagcacagtcgccaggggcaggacatctggcttttgccgatgcagtaacacgcccaggaattcctgtatcgtttccatctcgggattctgcagccgaatgaatcgaacaccgccacctccgcgcacaaccaatggcaatcctgtggcacgaatcgcagttgtcttgctcatcggtgtagaccctatggaaggccctttcaagtgtgaaatcccgtccacaagagcatcgtgatgaaagtctccgagggatccatgacttcccacgtggctgtgcctggtattatttccgcccaagatttgcttgactttcatcaagcagtccacggtatcgcgatgggtcatgatcagcacaatcggtagtcgcttgttgacgttcaccaacgttgacagtagcgcaatcgagttttcgtcggcgtaatgaatatcgtcgatcaaccaggtcatgaaaaaatgggttgagatgacacgtatgagtttcaggataagggcatggaaccttgctgcagagttggtcaacgagacgtctttgctctccaagttttcggtcccgtcaaaaaagtacttgagttccggtacaagatcgcatatgatgccaataccagaagatggttcgaacgccgtccggatcgcgatcacgagcgaggcgagagcgtccgtgtgctgagtcaggagttgctgaagcacgctttggatacacgagagaatcgccgaatatggttcgtttccctccgcctcaaatattccacctgcaaacagtccagagtttcgagcgacctgcgccattcctctgataagaaccgacctgaacacgcggagagaggagagcgaattgagaaaaaagaaagttagatcgaaggacatcctggctaattctgttacaaaaatccctgctatgcctgcagagtcttcttcggtttgagctgtggcatcacgtactttccaactccagagggtccactgacaaaaatcgctcggacgactgggtcagtcatctctgattcacggtgaacggacttgcctccatcaaacggctttggagttctgagcagcgttttagatgacagcgggatcttggccgtagactgactctgtaaagacacaatatcgtcgtcttcgaaaatataatgatccgagtcgttgatgacagtcgcacttggcgcgacaaggtcctcctctagcggacttccttctgccacgccgctgttcagtgcttgctgatacgctgtagccgcctgtgagattgctgccgatatcaactgttgctcaacctggcgtccgaacacagcatttggaataataaactgataggaaatgtcgtgcttgccgagagggaaggactcgatctatttgacacacaaagaaaacaaggtcagttccagaatttatagagttgtttttttggttgctagcgtggacaataccgttccagacttgtacaactgattgagacatcgaagtatatcctgcttgaagccaaacgcgttttgatagcgttggcttggttgctacagtattgagacggattcgatagtggtccaaaggctgcattagtttcccaccgcgccatgaagccccagtcctcaaaagtatccatcaacgttgcctttaccttttgcgtcatcttgcgaagaatgtcatcaatgatgggaggcatatcgggtcgaaatgtccgtaagggtgggagggaccgagagagtacacctgaaatagagacgcaccagagtcgagtgtcaatttgcagttgaaaaaaggcacttatctgtggatttcagcactcacagaaaacaacatcccgttaccttgaaggatttggacgctgtcatttccaggatttgggaactgcagtgtcaatagcgtgaaaagagtggcgcccaatccataaatgtccgtccgatgatccatccaagtctctgctctgcccgtctgctccggggctaggtactgcaaatgatattccatgtatccgggaatttgccattcaaagatattgttcggtgcccgcgctcgctcatgacttagaatcttgctgtgtgtaaagtcaaagagtcgcagcttcgtgtcgttgacgtcccaacgcggtgatactgtcgcgtcactcaatccatgtgtagcccgagttggttgattagggcatgccgtagtattagtggcagtgatttcgggctcatggtagagggacgttggattccgttgatgtgtttgctgaggttgctgatgctgctctggtccatcactcgttgcatctggtaatacgacgtccgaggctggaggcgcccaatggaaagcggttggacagagcgcgagatgagcaaggttggctttctggagcgcttccagaacacaggccacctttaggcaaaagatcaagaacgtgtacacatccgggaagggcgatacgggttgccgtgcagcaggaatatgtgggctttgatgtccatctgtgtcgtccagtcctgcgaagcgatgatgatgcggcgagaggaggttggggcccagccgcctcatgatgaggatggacatctcggcgcggtccaggtccataaagccctcgacgatcctgttgaagtacttttcgccctctacccatcccatctcatacactgcctgctggagacctggagtgtggtggcatcctgattttatcttgcctgcgctgtcgtcgaggctctctacgtctgcttttgcttcttcgctgagggtggatggcggtgcaaactgtggtggaggtgtgccgtgtggatcgaagcggccgtcgacgatctgcaggcgctttaggatgcgatgctcgtgctgcaggagcacacgcgactgatgcagcttccctgtgacgggcatgccgtctgctatccgcgttccgatcaccaggcccatgttcccagcctgcgatccagccgcaaactcgtatccgcgcaccttgggtggcacaaacgcacagctgttggactgcgaaggcgctctatatggattgctataaggtgcctcgtctgcggcctgctgtgacggaggcggtggctgcggttgcagcggaaaaggggctgcgcgaggaaagttgggcggtggtcgggcggccaagtgagaggtaggactggcgatgctgtagtccttgtcagaccgttgtggaagagagttcctggcgggtgggagtgaggaaaggagtgcggacggtgctggtggggtgatggtctgtgcagtgaggacgggccccatgttgatgggtatgggcgggatagggagagcgctgagcgtggcgccaaaggtgctagtgggcgaaggggaggtgtgcgcagagagagccacggccgtctctgcgtcgccttcgaactctgtgttgacgaggacagccaaggacgacgacaaggacgcagaggaggaagacgaggacgaagacgacaatgacgaagtcgaagaagcagacgcagcagacgaagcggacgaagacaagaaggatgaggacgaggatgcggatgaggatggcgaggatgtggatgggcaagaggggaacggaggcaatcccgcgatgggcgcatggtgcacctcgggatagggcggaggcgcctgcttgagcaccgaggccagcgtggtctgcttgcagcgggcgagctgctgcagcggaggccgttgtcgctgtagctgttgctgttgctgttgctgtagctgttgctgttgctcttgcagcaactgctgtggtgcgctgccatgtactggcaagggtacatggacgggtgtgtgctcatgcgtgtgctcatgcgtctgcgtgctgctgctgctgctgtcgggcgtgtggatggccatggtcgattagagatggcccgaggaatcaggaatcaaaagatatcgaacaagggtctaggctcatgcatgcgccaaaagggcactttggtcgtcaaggacaaggcgaatgggacaggaagacagcgacaacagagacaacaacgtgagagcagaaagggggtgcggtctgtggtctgcaagaagggaaaacaggcatccaacgggtataagacgcccatcaaggtttctcccgcgctcagaacgcacaatccgtttgggcggttggcgatcacactgtgatctgattggaagggaacacgtgtgaatgttcaaatctacgtacagtcgactctctataaaggaaacgggcaaattagcgtttgaaacaagcatccgtcaggtttacacaacacatagccacagtacgtgggttggtctgcttttcaaggcagctccagaggcgccgtctgcaaatgaaaaaataagcccaggtgagacgtcgtagcaaagtcataatgggccaaaatacgctgaccatgctgcttcgagggcacttacaactttttcatggggcttcgaccccaataaaccttttaaagatgacgagggatcttggacggccctgcctccaccggaaaatcctggccagaccttttctcctttccctttcccttgcccttgcccttgccctgtccctgatcctccggcttatatttggctgggcgccggccatcgatcacctgtgcttgacaaaccctgccaatattttccgccccaacagcatcacgatcgaaaaaaaccttgcaacatgggcagtacctcgttcgacctttgatcgccctcaaaaactcggtgcagttgggtcgcgggcattttgctgaggtgaagtactcatgtgcacctacaacctcgtagccgagactttttgcctattgaacagacgcggtgaatctatgtcagcttgcgggtaaaagattgtttttcaactttcacattgtccaaagtgcgacttacacgctcaaccaaatgtcgaactaaaactgaatgcttcgacgggagccccgtttggctgttgaatccagctaagccgatgcaaatgatcactctgcgttcccctgactcccgcttgcgcccttccgatccgcctgcgagccggaggataccctttatagcgagatcaatgcaggacctctgcgcttttttgcaatcccaagccttcttcataatccatttggagcgatagaactcaagaatcctgtcaaggttggttgtttcttgatttggtgtatcgtcaatgggtcgcaggagatatttaaagtactgggatagcgtccttcgcgagaacgtgggaatgttgctttccgcctcgtccacgcctgcctcagcctttcgttgttggagaaccgacctgtaccgcgcgtatggtgtatagagcatactgcgagtgaccttgaccgtgtgtcgtgcactgggcgtctttggatcgatcttggcaacgaccaaaggattgatctcgcctgggtcggccccaaggatgatggcgtctttgaactggtctcgatattctgggttttcgaacacaacctcaacattctccagaagcttgctcctctgtctccagttgatggcatatgctgtggcgttagaggcgcttgatgcgcttgactcggcctgtgcctcagttatctcttggtactcctgtatgacgatactggacgtccctgcctgtaactgaccctccagcaaagccttctcttcatcgtctaggctgtcaacagcgaggaaacccccctcgatgtccatctcagaatccagctcacttgtggctcccagtgccgcgtcctcatcatcgctctttgtctctgctgcctttctaggcctcgggcttagtgtgtcgtaggcaagcaggtggacctctagaccgttggttacaatagatcctttcagcttgtattttgtggcatcagggtcctgctggaccgaggttgagccatagagtcctgttccaaagagggcctccattaagcgaccaatgtggtctcgcgcgtaatcctgagctgcatttttataacggaatgtctctggctggcccgtgcgcttgttcaataccgagtcctcctgactgagttgctgcatcacgcccttgataatgcttttggtgtcttccctggcatagaaaatgtcgaggagtacgcattctggaaggacgacgaagccggttctgaacttggctttgggaaagtcgcagtactggccctgagtgttcattcgaaaaaagtgctcaatgtcgctgagaccatcgggatcgggatttggacttccttcgaactaataatcaattcgaggacgagattgagtaactattcacaacttcatactgcatcgtcaataaatcgtagttttgagttctcgcttaccgcacagttcctgtaatgtgatcgaagagacgcctggacagggaccattgccatatctgtcataccggtaatgggaatgtctggaacgctctctttgagtggaggcaggttcgtcagctccgaaaacagattgtacgcctcttgggctgacgctgccgctggccttgttgaagtcgactgggccgcataacctttgcctgaggcccccccatgatatagcattcgtgcgaggttgttcacaaatccttgatcatcgatggtctggtcgagaagtgcttttcggcgaggcgcgtcctgagagctgtcgtctagaagatggcagatataaatcgctgcggcccagtggacacgagtttgaatgtcattcagaagaaaaacgacctcctgtaaccgtcgttgcagcggccctgcctctgtctctcgatccatgcccatttgtaccatccgcgctgtggctgatccgaccatgagtgtcttggttcggaactgcgtcctcagcctgtgatcctgttgcactgcgggccggagagtcctcttcttttcggtgaccttgttcgtcttcttcttggcattcttgcccttgtttgcgatgggtttcttcactgcaggcgggcggggacgaggtccagagacgcgggccgggagctggtgctcgtgttgcttggattttgttatatctttgcatttccggccagccagaatcgactcttttgtctcaaacacgggccggaactgattcgaggtcgattttctgggcacataaaagggcggcgaggtcctcagaaccgtggctctctggtccttgatcgtcagccgcagattcttcaggcgcttgagctcctgcatcccgttcttgtgatccagatcctcacgggctttaggcccttctgccggcgtgacatgcctgtccaaaaacacgtgcctggcgcaatcaaaccgatccacggacacatcctctgaagtctttgtggcagcgacctcgacgtagcgctcgagcattatttccgtcgtgtccagcgggatcttggcaatgatctccgtgttgcgggccagtccgagctgcttgatgttgtctgagaaatcattatcagagactgttgcgaggacggccaagtgcgcttcgcttggaagctccagcgccttcagtgtggcctctttggtgtatactccgtagcccgtgctgtgagggagtggtcgcaggactgtgttggtgccctcaaatccgagcaggtcactgtcaccggacactgcgatggcctctggctggtgcagcacaagagtcgcaatgcacagatcggcttcgaaggcgcacctgcacacagggacagtggtcgccagaccctcaacaacagcgtccatggtcgcaccagggaccacaaacatcttactcagacacttgttgatggtggtaatgaccgcttttgaggtccacctcccggcacgtgagcgtgcgtccatggagctcaggttcttgtccagcttgaccttggccttgtctctcttgtcctgtcgtgctcggtgggctttctctttctccttagtcggctggccatcgcagtgcacgacacagtgctcgccaaatgtttccaggatcagcctgccaaggctgacgccaacgctgaacccactttcaggtgacgagtccttttgcaagcgctggagtaagggagagtagtagcaccctaggaaatcgacgtggaatggccgtcctgccaggctggatgggtggatgggaggtggacaaagccccttcttcttcaggcgctggtataggccggcgattcccatctaacaagcaagtcgtctgtgaatatttattgtctagtgtgcccttcacaagatggcctgaatgaaaatgtgccgcggtgtttacttacagcggataagaaacgtagaaaagaacagagcgagtggaaacagaactggacaattgcgagaggaggggataatgatcgggaaggtggcagaatgcaagaggagctgaggcgcgataaggtggaaggacgcagaaaaggaaatggagatagaagactgggacaacagcgggtaaaagacactatgatagactgagagactgagagactgagagacctgtgattcggggcagagaaaggcaaggcttgtgaactcaaaggcaaggtccgtaaacacgaagtgagggtgagggtcagagacgggacagagagtgaccaacgagttgtcgagggagagagaagagaagcaacgaggagaaatctgaaaagggcaaatggacggccacaaggccactgatcatcaataatggccaatagatttttcactataaggcgcgaaaactacacacatgcagaaccatcgctacacagctgtggatgacactcgtccagctgcgttctgaggcagggtacaaagcgcaaagccagcgactgcaatatagcgtatgatatcaagactgttgcaacggcgacagcagcaagaggtatcactatgagagtcagtgtgacaatgctcctattgcaggttctatctaacctaagcatttagacaaatggtgcgatacgcatattcgtagaagcacattgaagcaccatcaacccagtcgtctatgagcttggtgatgcactttggggcggtataaggtcactccattatttcctttatagagagttgactgtatttattttttctgtccttcgcgcgtgcaccctccttacgcctgtgcctcgtcggccttgctgtcgccagacttggcatgcgcatccaggttgagcaccagcagcgtggggttcattcccagcagctgcaccagacgcccgccgccagcctggctcagcagacccaccacctgtgaccgcagcgtctggatgccgggcatctccaccatcttctccatgtcctccacactcacgagcgcgtcatccaccttgccgcccagcaggatcatcttgcggtgcttgtccaccaccttgcggatccctgccagtccctgaggcaccttgccgcccgacttgagttcctcgtcctcggcgctcatgttgcagctgatcacacacgtcgggccgttgatcaacggtgccaggttcgcatagcgcgtctccctcagcgccgctgcaaaaatccccaagcgcaccaccttcatctccgcaccggcggctgagaggtcgttgcggagctggatcagctcgggcacagacatgttgttgtgctggcagatcaacatgatccggttcgatgtcaaaatgctcgagtacgtctggtgcaaaaatgtcttttgggggcgaaactccttgccatagttggtcagcttccttcctgccgcctctgctgctgccgcctttgtcttttgtgatgctgctctacttccagagatgtgtggcgtggtcgaggcatctagtgatcacaaatacgaaagatatatacgatgagaaaaggcccatctaagaggattcactattatcgtccttttctgacaggtagtcttttttctctcttacattggcgaatggtcgtcagagaccgcactgagcgggcagcgactcctaagagagcgatataagagacacaggtgagaaaaacggctcgcttgcttcgtagccgtagccgagtcatatcgcccctgtcaacttttgtcgatatgcaggatgttggctgagcgtagatttcaagatacgatcctgggaaaaattccatggacattatttcattctctacgattcctctttgcagacgaatttgccccgcgctatcctttgccttgtacatggtcgacggcgaatatccgacttgctttctgtcctgaatcctgcagctgaggcaaccatgcaaaaagaagcacaatggcaacaagaaagtaggacaatgcctgggtgtccgggcagaagagtggtgctggcaggcaaggtgtcaggtgcgcaagagattacctcttgcggatggaaacatggccttcagtgtgtgaatgtgtggtgatggagaacaagtgtcggtgccggaaacttcaatcgtgtttatcggatgagtggcttgtcctccaagtgtcagtgatccaatatcgagtcgacagtcacaacatcgatgttgaataaacaaaaaaaaaagaaacctccacttttctgttgtttgtcctcttttaaccacacatctctattaatactatcgtccatgtcaccgaaatccagggaaactgtccacagcgacatcgagtcgagcgacgacgagggcgttatcaagaacctgtatgtttataggaaaacctaaaagccatgagcagacacggactggctgcacacacctccactactgtgttttttttggaaagcgtggatatcctccccattggagcgtatgtttcagcaatgctaacgatttttgcacacacgtcgcactactctgcaccgatatagggactacaaaccaccaaagggctttgcagcacatcgcgccaaaaagaacacgacctcggtattcgatgtggacgagacagttcagcacgagttatggctgatccgcgtgcccgagggcgtctccaacgaggacctcgcctccatgtccatcactctccctcccgccacatccgcatcaacagcagcatcatcatcatcagcggaggaatcacacgagtccgtcaccttgggcaccctcaaaaagaaggagacctccgccagctcccacacctcgaccaccaccaaataccagctccgcactgtcaccaccgattctggattcgcaggagagatgctcgccctccagcccctcgtccccgattcatccaagggcggtcgtctggtccaggcacccctgggcattcgtcaccatctcgccttggtcgcacagccttcgatcccctctggagaacctcttgcagatgagatcctgtcaagacctattcccaagagagagcagcctgagggactcaagatgcgcttcaaattctcgggaatggagactcaggtcccaggcgccaaattgtcgggttcgggaaagaagtttgcagagcagtgggccaagacgctggaaaagcgacagcgggaacaggaagaggatttgctccgagcacaacaggcagaggcagaggcagaggcagaggacgctgaggaggatgaagatcaggcagaggtagaagcagaggaggatattgctattgccgctgcagaagaggcacaagaatcatccaacgcatcatccaccaagaagcgcaagagcgagcaggctgatgtcgacgacgaggatgaaaagaaggtcaagaaggagaagaagaacaagaaggaaaagaaggacaagaaggagaagaaggacaagcactaaaaaacaccctcagcatttcctatcaaatacacatcaatcacatctctacgttatgtatctcgggaatgacaacatttgtaattgtaaggcgaagcgattggcaggtgcagtgtcctctggatcccctcgcgcccaaggctagacgcagaagttcaaggttacatgtactgaactctgcaatccgcatcgccgatgcctcgtacccaacgcttgaagccgctcacgaaatcgtcgagtgaaagccgcccacgaaactgtcgagtgaaaactcgagcagtgcgcatcctgatctgtggctgccctctaccaggaaagagcccctgctcaagaaaaagaactctcacacatcgccatcgtgatgaaatccgagaggaatcccttcgggccgctaatgctggactggtagagttgaaggagcgtgtggatggcgaccgtcccatccgcaagcagcaaattcttgaccgtcaagaagaatttgtccaaggcttttcactggtcactcgatgcgcgccgatcgtttaagatctatcttgagtcgcacgggtgggatgtacctttatgcccaaccgaagctgatgtcaaaattgccgccgattgtcagccaagcgacgtggtcatttctggtttgctcgcacacgaaaacgtctcgataaattggcgaccgctatccaaagggaacttcctggtctatgtgctggaagatgtgctaaaggctttgagcctcagcagagttcaactgaccatgctcagtgtggtgtcgaaaaacgactatggccgaaacatccacggactgggatgttccaccaatttcagtatcatatctggcagttgggacaccaagccgagcaacccttgcggatatgaaccaggtcctgggagcagtttgggcgagaacattttttagatatgtattcctctttaaccttgacaaccaaaatacccaaagccttggcctagaggttaaaaataaagataaagtcgaaggatgttagagagatggagtgtgtagtagagtgagagtgggagggagggccgcagggcaaaagtcttctcttttctgtttgtcacgtgcagtagagcttccctcttggggatcacatgttttttgctcttttctggtgtggtgtggcggatgggtttagatgaaaaattgagcgattggggtgatggctgctttcctcgcgttaccattctgccatccttcctcacagcacaggcgtcttctctaaggtaaaatgatctgcaaacctacgctacatggaggtcttgccctgttagctcgtcgtcctctagcttgtaatgacgtggccagcaggtttgtctgtgctaatgtcgagcggggatatgaccgcagggcagatagccttcagtctgaagccctccaagaaccaggttgaaccgtcagactgttggattcctgtagtgaagctgcagcgacggagaaatggagctcattgtcaacaaacggctctcctttagatgcaaacgtggtcaaaagatgcttctttgcctctctgccacgtagttcgaggaggtggctgtgacaattgatccagtgctctatgtgctctatgcgcatgctggaggcgctccctttctccatcacagttgatagacaaagtactcggtggaggctggaaggcctcttaactatctgggttaagcacaattagctaggtaccatccggagtagtacttcctccttagcctctgagatggcgacagctgggaccgatcaacaacggggagcagccagagtgcgcaggcagaaacaaatgctgctaaggatacgaccgtactcgggcattacatgcattgggccctggagcagtatgaaaatgagtatgtctcattcacgtctttcgtccagaagttcaaactatccgacttgcaggatgcccaagatgcctatgaagccttgatcggctccacacggcttaaaacagcatcttgtactgttgcttttacgtcttcgcatacagactagatcatagcacaatccataccctgtggcgaggctgtcctcgaggacgtggcgacgaggtcggcggggactaagtaggaaaagagggtgatcagacaggctggagctgaaaggggaaggggcgaggaggtcctggtagtagaaaggagcacatacctctggatgtcgctggtgaaggagagagcaaaggcaatgagaaatcgtatcccaaagtgaggtgacctttataccactgccagttgtcatcgctacatcatgcatacgtcgcattgatagaagcatgacctcggcttcagccatgatgatcaatggtgatggcagctgtggtatctagccgcttgacatacgggtagcaagagcaatcgctagtactgtagactgtatactagaaaagggccttctcttgcttcttcttctccttgtcctttttcgagttgaagttagcagagaattgacttcttgcaaccataggtatgattcatagtagttattgctgtaaaacgggtcctttttcgagttgaagttagcagagaattgacttcttgcagccataggaccaacaagaaatactatctagaactacctaccccaacagtaaacacccaaagatcatacaccaagaaagcacaaaacacacacattcacaatctattcaccaacaagtccgtcactacgaccgatggccagtccctccggagcgaccactccaactagataccacacgagacaacgttcgtcctctattgacgcgatccagaccctagcttccgggtttgaagcaaattcaatagtcacacctcatcctacagcccagccacaagtgacacccatgaaccccacaccacacagcgaaataacttgcggatatataataatttcatttgttcaaaaatttatgaactggacaatgatttttcgtttgcactgctcctactgtgcctctgtgagtgggacatacggtttagtctgttgtccatacgggtgcggactctcagccactgtccagaaagcctctgcgtctggttatgctcattgtcgctcacctaatgcctcacaggtgcgggcagagatggagtttttttttattattgttcatactgtgtttctgagggtgggacatacggtttagtctgtatgttcatacgggtgcggactctcggccactgtccagaaagcctctgcgtctggttattctcattgtcgctcatcgggtgcctcatagatgctggcagagatggaacttcttgaccaattcaggttgattatttgtgagcgttgtatgttgtatgcgatgcctcgatgattaacttcagtatccgagatatcttattagggatgaagactttcaaggatttcgtacttgccgatactcatgggcatatcacatttgaaaagatgtactcttgcttttagcctttgttggtcgggaacgtggacgaggagacacctctgcaaaggattacaagatcaacgcagatcaatgtcgagatgaatatcacgagctgctaatgcagagcaacataagctgttcacaagcatcggcaagtacggtcgttagagtggccgctgtatgcacactaattgtgatatgggcctcaattgcactgctttcgccctgatcattgagccgcgtactccatctgcccttgccacatcatcccgttcttccttcactcctggtgctactcccacatcatcacgcctcagtagcgccgttgccgcacatctgttcaggcgacgcgtaccattattcaggttcgtgaagcagtttgtccttgagagctcaagactaccgcaagtgaaggacatagattacatccattcaatcaatatgcgctggtgcttttttagcgagctcctgtttagtgcgcggcaggagggggtacggaaagtagagcgcgattgaatgatatgatcagagtttgaacttgacacccttactggtacttttttagcgagctcctgtttagtgcgcgacaggagggggtacggaaagtggagaaggggtgaaggggcttgatgggtggagctgttgagatttttgtgatcacactatactaagcgcgcgatatatctttatgttagggttactcatcagacttgttccaatgggctctgaaaaccatttgaccgttccccaggcacatgtggaatggttaaaacagaaagtatccgaaggcagccccattaccttgcccgaattcgccctgtccttcgactaattctccaaggaggatgcagaaggggctcttctgtcaaaaagttttattgcgaagtcggtgaagaatggtatacggaccgagttcgaaaactggaaacgcaatgacggggacaacttttgggcgactcgagtagcaacgatgtctaaaacacggacggccaccgtccttgctaccactctctttaaagtagcaggcaaccaagaatgaatgagaggcatgagtgggatcttttatgacgggtacaaggatgccggtggccgagttattaagggtaattatgcaacacttttatagcaaaggctgggcaaacgtgttgctatcttactcgggtcgagttgcgctcgagtgcgtctgtcagtggctgaagcacgctggctctgatcgagttataccacaagcccaaaaaggtcagagtcgagttggtcatgagtgcctcggacagtgtttgagctcctgtgtccccgatcgagttgcaggtcaagttcaaagtagtcagagccgagttggtcttgagtgcctgggacagcgcctgagctccgctgtctccaatcgagttttcccccaagcccaaataggtcagagccgagttgatcttgagtgcctccgacagtgcctcagctccgtcgtctccgatcaggttgatttccaatcttaatgtgctaagagtcgggttggtcttgagtgcctcggagagcgcctgagctccgttggctccgatcgagctgtcctccaagatcaaagtggtcagtgtcgagttggtcatgagtgcttcggacagtgctgcagctcctttgtctccgattgagttggaggtcaaatccaaggttatcaaagtcgcgttggtcctcagtgcctcggacagcgcttgagctccgttggctccgatcgagctgttactcaagaccaaagtggtcagtgtcaagttggtcatgagtaccttgcacagtgcttgggcaccgctgtcgccgatcgagttcccacccacgttcaaggtagtcaaggtcgcgttggttctgagtgcctcggacagcgcttgagctccgttagctccgaagcagttgtttgccaagaccaaagtggtcagtgtcaagttggctatgagtacctctgaaagagcttgagcgccgctgtatccgatcgcgttctcacccaggtctaaggtggtcaaagtcgcgttggtcttgagtgcctcggacagtgcctgagcaccgctgtctccaatcgagttccaactcaagtccagagtgatcagagtcctattggtcgtgagtccttcagacagtgcttgagctccattgaccccgaccgacctcatactcaagtccaaagtggtcagttcccagctgttctttagtgactcggccaatgccttagctgcgcagggtctgacaaggttctctccctgatatactgtagtcacagtagatccggttttaagcagttctgcgtaaatgcgaatgctcgatgcagttgtgtttggaaacggttctatctcgcaggataacttgcgaaggtgaggtggccgcttcggggtgaaattggagagcttgatgagaccccttggaagcacaatatgaattgatttcatattagggggggttcaaaatacgaccgaaagcttggtatcgtgttgatatcggggaaaatatgtccgtgaagctcggttgaaaacgtcgcagatccaggtgcaagaccatcactgctgatttggtgagcgcctcctccagcaactgaaggtcggtcgtcgtacagtcccagttcaagatgatgttaagctcttggacggacctcgcgttttccattgccagatagaactgctttgcggctgctctggatctcagatccacctgcactagaccttcgttctcgtcaaaaaatcctcctagtgactccactgcacgtcgcaaagtctccaccgacgtcctgttaaagttctcctggtagtggtttatgcacacccacttgacgtggccctcgtctgtcacagtcctgtacagatcgcccagcgccatgttcccgcctttttccttcagaatcgtcaccagcatgcgcagatcgacactctccagagcctccttgctctctgcctgcccagtaatcccctcgataccttcggtagggtcgtcagagatgctgtccatcatgcctatgacctgatccgctccaggtacgatggtatcctccagtaccttaaggctagtgatggactggccgaggatgtctgggctgatcaactgggaaaatgcaggcatggccataccagcaaccgtaattgaatacttgatcattttgaggatcgtgagcacataggggtcgtactgctcaaagaactttgaaggtcgagcaatctcgtaaccctcgtgcttggcgaaatggatgtggtgcgggatcccggtcttgctgttgatcgcctttgtgtgttccccacactcgcacaaaaaatagagcctgaacttgtttgcgaacggatttagggcgtcccatctcgaggagtcctgtgggagcaccacaaagagacgagggatcgggtactcgtgtggttcgtagttctgggtaaagatggcttggacacgagactggagcacagccaactgctcaagcatgctctcctgcatccgcttcatcttctcttggttatcaagggcttctttttggagctgtttgatctcatcccgctttgtgttaatgaccgccgtgttgttggtgatgacggcctggagctcctcatgcttggcggttatggtatcctgcagctctgcaatcctggctacatatatagcctctattttctgtactaagagcctgttcgattctgcgctgagctcgtctcggctgttctcagcatgggcgtggtggatggccttgccaaatgcctgttagatatcagtcgaggatcgaaccgtttcttgcacttttggatccagaagggagatgaaccgctgctcgacctcggactcacgcgccttacttgatacttgtgtggcaacctgttgcaataatttggctatggtcggttggctaactttcagagcgtcaagcgctctgccagcttcagcacccgcaaaaggattacaatcgccgtcagcgggacagttttttaaagggttgacgcgaccaggctcgatagaggtcgtcatgacaacttccataaccacgcgactgtgatataattcaacagagagggagtataagtcaagaagccctggtcgtagagactgtacacttcgacgcattctactgttcgctgccagtacctttgcggaccacgatttctctgaaacttgataactgatttaccgtcacggacgtgcctcactccagggaacgcctgccttatgtcctcccacgacacagtggtctgtcctcctacataggtgaggctgagttcgatagcgtccatggcctcggtcaagcgactagactgcgttatttccattgcaatgtctggatatcgtggcaccggtgaatagaaaagagtgtgtgaatatgggagggcagtaagtgaagagaaaagaaagagaatcatcgcaagagcacgagtccaagagttcaaaaatcccaccttcgccatttgtggtgcggaggctcaaagccagtcggtaagttcgtcgggaaaaaaaaaggagggaagactttgttgcgtccgcatgatattttttcttcccgcagtgatcatgggcgcccacaacgggcattgggctcatacagaaatcaacagacggaatagcttgcgtacctttccttcgtccaccaggaaatatgtgcgcccatccagtttcgatgttcacgaggtgcggggagtccctgctaatcatcaatgcgcgccacgagaagaagtacgtctttcttgatttatgaatcgccatgccttcttgggacaagattcaaataaggttcagccgctatcacgcaaaacacgcaccgcgacttagccccctgtactcaatttcacgttgttgacgacgacattagccaccaaaacctagcaagaatcccattcataggcttgtagagcaaacaaatgaccgtggaatagtgtcgacttacatggatggatatgatcgactcatcgatcagcggtatacaatcatcgtggatgagttagtcatacaacatcgaccatgagctcattgcttctctgattatgataactcttttctggcacctactaccaaatgctactactaagaaataaagagcaaggagatatcttacatatagacgaggcaggaaatgtcagattctacaggagactggtgttctcagtcgatattggaccaggctcagcatcgtatgtcttcttttctcttgaaatgtttagacccctctgcgtgccccaaaagccagtaaaaattgttttaataattcacatttccactgccaaaggtgataaggtgagtgatagttgagcgccgcacattcaccgctgtctgcggtatgagatcgttgtaaggagtacttcggtatctctcaacgatacgtaaggacatctttgtttacagtgttcagagaaaagaataaagctgattattccaacgactgcttgctatttagatcttgagctcaattggataacgttagtacataacggagccattcatgggctttatgttaccttgatcgactgttcaggaacggattttcggagcaagacaggagagtgtgtttgataagattcatggtcggatctcggaggacgtgcaggccgacgacgatagcgatgacgatgacaacgcgcacgcgaacgacgactacaacaagatgtccgaagtcgcgtttatgtgcgatctcttgcattgcatttataaccgcaggccatctaattccaagtcttgcgctaatgtacgcctcgttggccagagatactattgatctgcacctccgagagcggcgtaccataacatcgatattttgtctgcagatcttcggtaagtgacagaacagcggaagtgaaccaagatatttcatttatgataactttctctgaaataacgatttcgtgttctgtcaatcgggctaggccaccaactggccgtatacgaactacgattccaagcagggttatacatgtggatcgagatcggcaccggatatttaccgcgcgtcaagaatgccacgtactgcttgattcacgttatggagcttgtgaaaaccctcaaggtgattctaacattcagcagtatgaaaagtaacagagcatgggactcaaggtttgagggactaacgctagggcaatgcttgttcttgctcctttacctacagactcttctagacgatatttcagtctatcaatatgtccgtactccccccagccgcgatcctgaccatcttataccagaagagcttcgaccacaaccaactaagatgacccctacttcacggcggtttcttggttgcgttgttaaggcaacctctgataaactcatgtgaagccgatgtgcccatctggtatctgactgtattctctatacatgcagacatctattcaatcatactggcggcatcgaatagcctttccgctccacaagtcctccacacgcaatatgattcaggaccgggagtaaaaagggaggtgcgactcatgtggtgccgtcgaacgggttccctcaaacaacgccaattcaaatagtctgtgaggcttgaggttgactggaattgtgtaagagatcgtggagcttctctgaaattgttagtctcaaagtgtactgtgcacccttgaaatttagcctacttgaaatagagtggtcagtacatggatgtataatggtaagctgcgagctcacacaccatgcatcgcgagctttaatgcgaaccttggcggaggtgcgtttatggattcgtgaccatgtcagcgtgtcacagtgatcggtggctactttgatggctcgtgcacaagtccggtaactctctcagtcattgtcgctcgctgtgttcctgaaattcagggcaatttcagcccctccccctccccctgtttcctgtcaccttacgcattgtacatcactgggtaacgtgcacgttgcctacccatcccgctcccctctctccaggcggcgctgtgcaaacacagaaaagggtatttataccgcctctccctgtcgctgcacaaacgtctttttctcacactttgacacgcacacacattactcccatctcctcccttcgaccttccctctcttgaactctgacgaacagccatggtcaaactccaaaccttcgctattgtatctcttgcctcagtagccctggctgccccttcatggtgggatcagtggaccttgaccaacagcagaattggaaacaccgacagattcaacgctccgactggagagaggcgcctggtgcagatagctgaagacaaagcacccttctgggcgactgaagagcaaaggatgcagatgctcagggacaaggtcggttatatggatgtcaccgaccatcaagggtttcatcatcgtctccatacccgggtcaagaaaggtatcgttcgagtcacattgcaccctaatcaactgtcgtgacagaatggctttgaactactagcgcacttttttttaatgttacttttgttgacgttgctctccacagctctccccaaggcagctgtccatcaggacaagtttgaccgctacgtcgacgagctgtccactgccaatatgaaggttgcattgaccaaattcacatcgttcaagacccgctactacaagagtgagcacggtgttgcctccgccaaatggctccacaagcagatcagcgatctgatagagaactcgaacgtcgtctcggatataagtcttcgcaaattcaagcatgagaagtgggatcagttctccattattggtaacgatactcccctcgtctctccttctgaatcttagtctatctctatgtctctctctatgccgactctgctatccctcttggatgcgaatgatgctgactcgtccgttgtaacgatctgatggtcatttccagctcgctttgagggcggggatagctctttggctaatgcgcctgttattgttggagcgcatcaggactctatcaacgcatggtttccatcccttggtcgctcccctggtgcagacgacgatggctcaggcacggtcacgaccctggaagttttccgtgctctcattaacaagggcttccgtcctgtgcgccccgtggagtttcactggtactctgcagaggaggtcggactcttgggatctcaggacattgctgaggactatgcccaaaagggcgttgaagttttcgccatgatccaggtacgcgccattgccattcgagaaaagaatagagggtgtctccaaagtgttcagcaacttcatgtaagcaccattctttctgttttctgtcctgcgaatatgtgcctttgtgatatccttagaacgacatgacgggttacgttggcgcacggtttgctgagagttttggtatcgtgaccgacaatgtcgacaaggagctcactgagctggtcaaggtacgtgtccgatgggaagtaaagaagcgggcagcgtgcgaaagttattgtctcaataacactggcgacgttgtgtttgttgggttgttgttgtttgttgtgtagatttatgccaaggagtacggcgacatcagtgtccgcgagacccagtgcgggtatggctgtaagtagaccgctccaatagcaccccttggacaagggcgttgcacccagatactgactcacctcccttccctccctctgctttacttgtcgcgaaacaaacacccaaaaaaaatacaatcattgttgcggttgggcattccaggctctgaccatgcctcgtggacaaagtacggctaccgctctgcgtttgcgatcgagggcgacttctcggacatcagcccgtacatccacggcgaggacgactctgtggaccacatcagctttgaccacatgaagcagtttgcgaagctgagtctcggctttgcgatcgagctgggcaaccaccgcagccgcgacgagtctctgcaggaggagtgcgagcccatgctggtgctgtagtagagtacgactgtcgagcgagactggtgcccggccaaataaaaaaaaccccgtccaagacaagcaattatcgtgaaagaccaagataccaaaaaaagggtccggcagacaatgcggctctgacgacttttgttcttgtttgttgacccctcacgccctcgctgtccactctcatcaatcttcaatcatcactccccactccaatcacccatcgccattgctccatcccatcccccctgcatcgcccgtcgcccatcccaccacccttggatcatcaccctctccagcactggttgatcatttgccctgcttccttgccatcactgcacgcccttgtctgattgagacactttccctcgcaacgcctgccagcacagctctcacccccgcctcactgtctcggctgtccacgcgctagtgcatgtccctgtccacactccacctgccgccatgagaactcctcgctgtcgcagcagctgctactactgcctgctgctgctcgtggccctgatcccactcacatccgcagctgtccacaggtaccacacataccacacccgtccgtctctcttctgccccactctctctctcagtcaacactcctatcgacaaggattgcaccatgaatgaagaaaaaaaaaaaaaaaaaaaaacacatttgattgaacagctgtcctcatccccaacccattaccacccactagaatctcggtcgagcagcgctctggcgtcaacctgcgctccgctcaggtgcgggcccactacgaatccagggctgcattcatgtctaaactccagagcctacggggtcagagcacccctggcgacccctcgcctgcagcgcccagcgcaaccagcctggctgctcacaataccacagacgcagacatcgcaccaccagcaaagcgagcgctgatagcaccgggcacgcaggatccataccccctcgcctccaccacctcgttcttggacattattgacgaggaactctctggagcgttgcataagcgggctcttgttggactagcaccagtgcgcggtgacttgctcgacaagcagtgggttgctgcgatgatgattggatcgtcgcagcaagagttctcggtcattttcgacacgggcagcagcgatctctgggtgccctcgtccaactgttactcacaggcgtgcttgtcactgcgacgtttcaacccttcaaagtcgaggtaacaaatcaaaacactgtgcagtcgcaaattcccactgcgatttcgtttcgctgtatgtcagaaattggcccagcgatacgcaataacgcgaactagcacaaaacaacaagatgttgggggatgagatacccttcacactaaccgctttttccgttgtttaccaaaaatcgctatctctctagtacttttcagagcctgaaccagccatggtccatcaactatgcggacagcttgagcgtgtcaggcacgatcggagtggacgatgtcactattgccggtatcaaaattagcaagcaaacctttggcccggcctctgtcgtttacgggagcccaactgcgctagagtttgatggcatgctcggactcgcctttgactccaactcggaaatcggtatagtctcattcctacacgcatttaatgtgttatcactatttatcgttgggaaaagcaggttctctgtttcagtgcttttctgctcatactaatgctggtttcatattaatataggcgctgccacaccggtaaccaacatgatgcttcagggccagctggacgaacccgtcgtttctgtctggctcaacaaggcctccgaccaggacaaaagtctttcgaatggcggccagttcatttttggcggcgtcgacgactcgctcttcttgggcgagatcacatatgttcaggtcacgtccgcggacgactggcaggtcactgtggatgaggtccatatcgggcgcaaagagctcccactctcgtcatcatctgccagggccatcgtggacactggatcatcctatatcttgtttccggactacttggcagtcgcttttcaccgtgaaatcccaaactctcgctacgacgacaaactgggatggcagattccatgcgctctggcgaattcgcgcactgtaggcgatttgacgttcacctttggaggcgaaaagttcagtgtgccgctttcggatattgtgattctgacttcagaatacaaaggatactgcctgtccatcattgactcttggaaggaagtggatggccactcgagtcagtcggtaagtctacttgaaaaaaaaaaaataaggaaatgggttgtttcgactatatggcgatagtagacactagccacaccgcctcctcatgaaaaagcacactttttaactaatctcgcgtggggatcgtttcaattcgtgtttagggaatactgcttggagatttattcatcaagaaccaatacgttgttttcgactacggaaagcggcgaattggttttgcacaaaaggtcggcccttcgctaggaggtattggtctcaacgccaaaggtgctggagcgagtatccgactacgaatgaaggacgtatcccttcagcagcccggccagatgatcaccatcatggccatgactattctggccacactcttatcatcgttgtcgttgtaatgtactatattgttctcttaatgtaataaagtcgcgttctggttttccttttatatattccgagggtcacagcatgattggcgaccgttggaagaagcgcaacctagccggtcactatttattgacaatgatcttttgaaacgacgggctgcgaaggagtttcctctgatgtgatatcaagggggtttagcagattttttttttggaaacgccgagatacttcacgttttttttttgaacggtcgtgttgcattgtgtgaggacggagcgggggaatacatgtgcaggaaaaaaagggctgcacattcatgcgtgctcaggccaagaacaatgccgagagagcctttgagcttcacggggaaggcatgcggcctcgtgctgttttgtcagcacatcactaaacattggaggtttggcatactggcgtactattgcatggatctcatgcttgtacctggctttataccatagaagcggactttgggatctgagccgggcctatggccatagtcgacaaagactaccagagtgaataccatattcaaaaatagaccatccgcgggcggcccgagtggcggctcgccccactctctgacagctcccccccttttttccattcatgctgatgtggctacgaaacgctgagcttcgaggctcttgaccagacaagagacaagtcgtctaaataaccgcgagctggtttgaaccagctcaactccatcccttgcatcgttgaaaaactaaagcatagctgtggagctttgacaaggcacaccccgatgctctttgtttgctcaacattgccacaagtcctgtcttcgtttagtgatatacctgcgttgcgttaccgcggatgaggcagatccttcctcattgacccctcatcgcatcttattcctagacgcgctcatgcatccttactgttccgcgatccactgacctcagatccccgaccgcagattttaaatcgctgtgtcctagctctccctaatttagtcatcgtgacttactctttgcgcgcttccaagacttttcctcagctgccaggccagcattgtactacaaggctggcaatacctctgcatcttctggcctgtcgagcagcatcagtataaagcccacgctcgagttttgaatgtagtataacgattcttcgccccttttacccctgcacagcttattattttgcctgaaggttacccaccttttgggctctgaccgtttactgctccctctagcgactctgtccttcccctgacatagctattacatattttctcgtacacactccctcactttttgttgaatactcttgagcgatgagtctgtgtcgcgacgcagctgtctcttataaaatggaaggggaggctatccacgttgccaactttgtcttgtctgcatgccaaacttcctccccttgccaccttccaaagcctacttccgcgtctctcttgccaatacgatctcaaaccaacacgcaatttaggcacgcatttgccgccttggactgcactcccttccaccgctgccttttgaaaatacttttttttttctggccactccttttgacgatttagcaacagtgctcttcagccggccttcacctcctttaaattttcttttttgtcgttcctcaaacgtttttttcgatttcctttttggtctagtcctgaggatccagcctggctttctgttcacactccgtatttcaatcatcctttctgaaagagttgactttcattaaaagtgcttgcataatcgcaaggcgcgccccacaagactcggtttttcggtctgaaagtttggtaggttcaaaaccggcaggtgatctagcaggcgaaattggatcaacgagcaaggttcgatgaggggggaggggaaagggagaaaggagcgagtatctggtaatttcctggcgccccgatttgtctcctttttttttttgttctttttctacgcgcgccgggtttgttgaacagcctccaatgtaattatagctctactatgcccagttctccttgaaaaaaagaaaatgctcaggctgcagactgaaaagggacactttttatacgcggcttttcttgtcgtgtgtctggctctctttctctggttctctcgctctgcgacattgcctccctttcttctagtccccgccattaggcaaggccttgttatatttaattttttttgtgatacgaaggtcatcgctcctgagtgttgctgatgaaagagaaaaaggatccggaaaggagctgtgaactcggaagacggattgtcgtggccaagcagtctgcgactggtcttcaccatgaagaaaaagcagtgcatgcgatattgattgcttggctttgcaccggcaagagggatagccactcctcgtccggttgcatcacagccttattgtcctcactctcaaatcttactgcgagaagtttcaatgcatcgacctgatacacattgctccgtgctggctctttcagtgatgttacttgagctgaagtcaatttttttcctttcctctttgactatattactagtgtgcatcagcacccttctgctgcttttttttatattgctgcaatttcgccaatcccttttctccacaactcaacagcagctgttgattgtccatcggtacgactctttcatgtctggccttgtggtacccatcatctggtaatgacaagatcaagatacgatgcagaaaaaaagggtgcatgacacgtcccttgccccttcttcactccctgcgcatctcagcaaaaaagtcaatgcgctgtacatgtacatgacatgaattgcaatgtttgcttgcacaaagtggttcttcgccggcacacaacagaatgcggcacacacgaaatctgtaggaggtttgtctgctctagagatggccacgagaaaacatacctcgcattgacggcaagcacgcagacatgcacgcagacaacgcgcatcaacctacatgccactcgcaagcgtgcatagattgcctggagcgaccaccaccacggcctcttgctcacttgtttcgtgtccttacccgtggcttgcttctgctcgcttcctgcgaacaaaaaaaatgctctctgtgtgcttatatattgcgcttctcttttccgttcttcagtttctctctccctcccttctcttctctcaggctctgctccttgaccagctctgttcccatcacgattctcacttgattttttcttttttctctcacaagaaaagaaaaaaaatccccttcccttcccttccctttccttcctaccttcccttgtcatcatctgttcccatcctcaaccatcctggcccatacccactttgcttcgcgccttccctttcaccctctgcccgtcctcctgatacgttctctctccaaaaaaaccgtcctcctcactcacccataaagtatccggccccactcgtctcttctttccccgtcactctctccttctctcattccctctcgttctttctctctttcgctttgctcatctcttctcaactcctctcactctcttctgcctgtctttgacggaaccctctcctcgtttgaaattgtacatttcttgttgtaaccgcaaatcgttcgcccttgaaatagttgagcaaaacccccacagaccaactaaccaaattctttttcctgtgtttgtcaaacgcgttcctgtccaacatataatagagatcaaccttccgcccctactccttcccctctctcccttcctcctttgcctctcaacgcccggttccctcatcaaccccacgtccaacagttacgtctacgcgacctatttgctctctcagatatttttacgaccacggatcctttgttcatccccaccctcacgtcgctcggagcctcttttcccaacccaacacatcgacacaggtaagcgctcttcctttcgcaaaaaaaaaaaagaatgctgcacggccgcgacattagccatggcgcttgctccatgctgcttctttgtgaccgctatggaaacgagtctgcatgtccactgttacacgaatccctgctttggcatttttgcgtggtgctcttttgtgtctttacttttgttcggagagctgaagtggcatgccaccatggatggaaggtctgtcaggctctgtcgttgtctttatagagtttgcatatccggcccctccatctccttttttttcctttggttctacctctttctttctctcttcacgcccaccttgtccctacttcatgcggctgaacggacaggagccagctgtgaggcgagcatgcacctaaatctgtcgatttacatgcagggtgaggcagccaagagcgagagggaatgcgagcaagagcaaaagagtcccaagaggccgagaaccagagaggggtgggggggggcaaaggcaacaaagaggagtgagcgagtctcgcatgctcgagctccctcttgcatacggccgcgatgtagcgcgcgtcatcgtgcggatgcctctttctcgttttcttgtttttgcattacatgcatatcgtcctctctcatcctgctacctccccactgctgctctgttgaaaaccacagccatgtgcgttcccatcagacttggcccgcgctcgttcgcccgtccccccctttttttccagtctgtgcgaaaaccgatgtgggaggcaaaagggacacaaacgcactttggagccggtttggaatcaaacgtgcccacggttccgtggagttgagcgatccatactgacatgacgtgcctccttcttttttctactcctcctggtcccctcgccacagccatcatgaccgccattccagataccacattcgaccccatgtcaacacagcgcatgcctcagctctccacaagtcacctcgtcccaggtgcacccatggacggcacgctccgttcgccattgacgcccccacccacgcccctcatctccgataacggttccaacggtggacatcatgacaccagcaaactcacgctttcagcacgacagctccagcaccatgccctccagcccgagttcctggccgcctatacccttggggatgaacttggatccggtggattcgggtttgtggtctcggcgacgcgcaattcggactacaaggaggttgctgtcaagttcatcttccgggacaaggtccctgtccatggctgggccaaggatcccgagctgggtgtaattcccatggagatttacgtgctgaggaatgtccagcaccgcaacatcattgggttcttgaacgtctaccaggacgtcaagttcttttaccttgtcatggagttgcacggcaccccctggtcggccagcaacccgctcctgagcaagaataacgtcaatgccaagaacaacaacaccacgatggtcgaggccatggccagcgcgaccttgaaccaacgcatggtcggatccgcctcgaccacgagctctagcaacacgtcttcgtcgtcgctgtcgttccccatgtcggcctcgacgtcgtcgtcgtcctcgagtctgagccactctggcagtgagagcgatctgtttgagcccccaaagcccgcgctgctggtccgccgtacgtcgtgcgatctgtttgagtgcatcgagcaccactccaagttctcagagtcgcaggcgcgcatgatctttaagcagattgtggagtgtgtagactacctcaactcgcgcgggatctgccatcgtgatatcaaggacgagaacattgtcattgacaatgactttacggtcaagctcattgactttggatccgctgtcattatcccgaggcctcagggcaagctctttgatcgcttctacggaaccatcaactgtaagtgaagacgattgaggaaaaagaaaacagaggggaacgacagcgcaattaccgctagattggaatggcatcgcgcgttttcttaccaggttgcttgttatgtttgctgaatagatgcttcgcccgagatcttgaagggtgaaaagtacagggccgagtctgccgagatctggtcgctgggcattctgctgtacacgatcctgtacggcgaggtgcctttcaacgacccagtgcaggcgatttcggggccgtacatctccccgcgtgtgcgctcgtcgaacgagtgcctgcatctgttgaactggatgctctccaagacccctgatcgtcgggctacgattgaggatgtggtcaaccacccctggctcgctggtctgagcttgccgggctctgcttaagcgaaagaaaaaaagagagacgacccctcttttcgcctgtgtttgtaatgttactccctccctcctttgtgtcttttatctatctaccaaacgggcacactcggactctgtccttctctttcttctccttccaatccacgctttttttttgtattgcagtgcattctgtttttaattattctcattaattatactcttctctttggtgagagaggggaaacccaatggaccaaaaaaaaaaaaacgcgagactggagctcgcactttttttttcaagtccatacctccctcaaactcgaccgtcttctctcgctgttctttattaattttttgcgcgtttgctgcttctagtctttactaccttactatttcgcactaataccctagtcataatcatcactctgtcaatcggcctatcatctcctctctctctctctctcccatctctctcttctctttcctccacctctttgtccgtcgcatgttctaccacgcatgctttgggaatatacgagtcatcgctagaatattacatctcatagcggaatgacccacttgttacaccaacccacgtccataaccatcgcaaactcataaagaacaaaaaaaacacattgttacagcgcctaaggttatttcgcttgcttgcatatgagatgcccattgacattgacgctgtgttgcctgcgggctatagccatctccagtagcggcagcatgcccgaggacggacgggataaacgaacgatggagggaggagaggaagaaagaaagagagtgtgaggcaggggatgttttgcatgatggtgcacaaatgcacttggaacacgcccatttttgtgtgttgtgttctgtccagtcagtctccgacgccactaatttcatagagccacaaaaaaaaagacgcttggattgatacgatagaataatcctctggtcccacacaaagctgtatgagcacgctagtcatgaagagagcaaagcaaccttgtgtgcgcccactggcaagaccagctgtggcaaggtatgtaggtctgtggcaagactgtggcaagaggtggcaagaggcttcgtctatagcccccgagcttgaaccttaaagggtcgggcacatcggttggccacagcacagcacacacctgctggaaaaggaaaaacgggcgttgggacacggacagcgacacggatgctgcagactggggggtctgttgtttccacggcacatggcccatgctgcacagacataccgcacacatgcagtgtataaaaagaccacgccccgtccaccttccatccgcacatctccacagctctgattccttttgttttcctcttggtcgtcctttaggccgtcctcgtctcgtccttttgttctctttagcgtctttcatccttttttttttcttgggtgttcatcttccgcactcggtgccctcatcctcactctttattcttcactcggatcaagcgtccatatcctgtcaaattccacacaactcaaggtgtttgtactcccactcctcaaactggtgttctaaaacaggctacacagacagctacacaaaaaatgtcctcacgcgttcaccactcatccacacaaccatggactacaaagaacaaagtccacaacacacggcaattgcagcagcagatcgagaagaacagtgctcggcagctggtggaggccatgaaagcccagaaagcagcagcccttcaggaacaagccgccgccaacatcccacgaacatcaaacggaaacccaaagagcgatccctctcttaataacgctctcgcagtcctttcacctttgctgggaaaaccgccgctctccggagaccctttgcacgatgtggaattacctagggcgcttgaaactgttgaggatgaggatggtgatgatgacagcgatagtgggccgacaacgcaacggtctcgtcacgctccgcggcgcatcgtcttggacgagagttgggccagcgataggccttgcaagcgtcgtatgtctgcctctcgcaagaatgcaagattgtggcagaacattctctcagcacccccatcactgccatcaagctcagtatccacatcagccacagcatcagcctccgtatcagcatcagccttgccgccctcctctccatcacctctcccttcatccactctgcccctaccgtccctacagcaaacaagcacgagcagcaaggcgacgggcacgaccatgggatccagagtgcctagtgcaaagagaggccggccctttcgtcgcccgtctgaacggcgacctgcaggacttcctcccagctttgatctgctggacaaaccacccgcgggctggaaacacccgctcggtacgtatggtcgcatccagggatcatcctgcaacagcgagggtatcgaggtcatccatgatagcgatgacagggtcgagaggagccgccgagttgagggtgattatgaatcacaaaaggtcatggaagccagcgcgaccctgacttcgatcctcgaaagcaagcctaaccaagcagaggatcagccatgcacggacggctttgtggccagcatcgagaaaaggtctcgtagaaggcggccacagacgccggattccagtgactcagaggaggatcagctcactgcgagtctgttggagccatggagaaagagcgggtcgctgggtcggtctcgcgcgtcgacgagcagcaggatgtcccctgatacagcagcacagcagagccgccaacaggaaacgagtcctagggaattacacggttacatgactgggcttcaggggggtgacaccttagcaaaggccttccaactcagcatccactctgaagatgagcctatgcagtcggctgcagaggataatggtgagacatacttgaaaggcgacatggcaatggaccggcgttcactttcagagcagagggagctgactgccactcctccgaaagctgtggacgccgctccgaggccacaaagtgaagatgagctcgagaaggctaggcaaagggtcgaaggtacgtgccctatgaacgtcagatctatacgctatataaatcggacatgccactgatgcactttttttttgtttgcttgcttgtggtagaactgtgccgatcatatattatcatccctgaggcgccatcagactcatcccaacctgagaaaggcgagatcgttgaggttgtcatggatggacacagcgctcgggacggcgaggacaatgagattgcgatcatggacatggacgaggacagctcccaaagcacgccgggtaccgaagtaggcgagactgcggaaaatacattgaacaaggacaacatcgagactgaggacgatagcaacacgctagtaatgaccaataacatccacatctcaccatttgagcgcatcaaggcccttgcgcagagaatacctccatcgccctcgatgatcaaccgacagaaatttcaatgtcatccagtctgcccgatgcaacatcaatggccatatccgcccccgacttactatccagggccaattcagataccgcatcaaggttatcacgtaccatatggaccctgtgtacctttctataactatcgccaagtgcctttcaatggctacacggaacagccctacgtggacactcacacgcctagcagttgggcgtgcgtaccttaccggcgcgagcagcacgctacggatcaccagcttcctgaaggtggcgagtgcgacctgcgctctccaacgccaggcagggatgtcgcggtgcagtcaccagggcacccgttcggcaggcaatcatcgagcgagtccacacctagactatcgtctgcatcaccctccgtggcctccccggaacactgcctgcctacgtcgtttgttccaccgcctccaccaggtcctcgtcccccatcgtggacccctccgcttccgcctggccctcgtcctccatcgctcacgcctccgcctcctcaagatccacgcccttctccgttcgttcctccacttcgtcaaagctctccacctacttcagcggctgcgtgtcctggcttgcagccttctcttttaccgcatccgttacagcatgatccggtcagtccaccagacaaggccctcgtcatggtagcgccccgcctatcggtctccccgctcaccactccagaacctctgagccgtgatgccactgctgagcagtctgcagacgagaccgttgccgctccggtaccgccagcgaaatttcggaaactcgcgatgagagagaagctcatgctggatcagaacaagatcaagaggatcgccgacttatcgaagcaaatgttggagaaacaagagcggctaattaagttgcatagcgtgcatttcccagaaacgcccttgaaaagtcgtcgcgacaagaattgaggggggaccgaccacgttatgtgaattccaacactgtctcaaaaaacaaagagactgggcagatttgcagtttcttgggcggaatttgtctttcaacaacacaaccacacgtatcgactggattctgtaggtagtttaccctccatacgatgttgtgaatataaaaaaaaaagcacaaacgcccttctgagatcatgatggaaaggtttttgtatgcatttctttgagttctaactatcgtaatctgtactcgctgagctgaaaagttctacataagaaaaaaaaatggataagctgtcaagacaattctgccatccagatctccatgcgactctggtaaactcttaaaccgggcaccatgtcccgcaaaaactcattggacaagtcccgctgcgccaggttcggatgcaccttccctacaacaagcttgagccgtcgccaggtcaggacgacccattgcagttctataaattccatacgggcctgcaacttttcacaatccagttcctgcagttgggtcaaagtcgagagcgcgccgagcccgttgtggagtctgagatctagtatggacgatgacgcactaggcggaggacaagcggtcatgtccacgtcctcgttggggtccgggcgacgctgtggattggatgaggttggtggggaaaaggatggacgaccggggtcccctagacgcaagaccctgaggttggacagggcacccagctggcgatagatttcctgatggcggaagctggtccttggcaggagctggtccagttctgtaatacagatatcgagttcctgcagatctagacacttccatcggtttcgtgccatctcgaccgcgctcacggcgggtgcatagaagacttggagtcgctcacagttttccagaacgtcctgcgcctcgacagacgtgaaatttggacagtctagggtgttgagtcgttggagccgttgacgtggacctgggtcctcgagcaggaggatgttggtggcctcccgtccaaacaaactctttttgacgttcagatgcgtcaattgcgggaggtgcttgaggacactggcaaactcgccgtcagacgcggtcgcgttcgagagatccagactggtgacggaatgaaactgacccgagctcaaaaaacccaaaaagtgcatgatgggtaaggtgcccgttctggatttccaggtgaggtgctcgagggccggacaggactggaaggtctggagttggtggtcgttcggtaggtaggatcgatccagtatcagggaccgtaggttcgcaaagccctgtgcctcggcctcgggggaagagtgtttggggcgttcgataagttttgaattgatgagggagaggcgagcgagggattgacagacacgaccgaatgtcttgccctcataatccgagacgatgaccgagtccagttccaggacccggaggttaggcatctctgccagcaggtaatagattctgtctaggacgacggggtcctgggtttggcgggtgaggggatcgctcctgcagatgaaggtctcgagcgtggcggtgttttgcagcagcagttgtttgacatcgtccgagtagacggtgacctccagatggcgcagttgtgtgcagacaggcaagagctgctgcaggaacgggcgttcaccgcccaaatagcgcagttgacggatgtggtgggcgttggtttggatgcgggtgagcgtagggtattgtcgtcgttgtggcggtgcctgtgattgttggcgccagtatggctgtcgagggctgaacaggccgtcctgtcggatttggagactcgggggcgaagggtaagggctgttgctggtgtagcggaacagggtgacttggtgccagaggaagggctcgaacagcacgcgccaggagcgacacactcgtgagcaggcgaggacactgttcttgtcgagcagagcagcgatgctcaggaggaggtcgactgactccaagggactctggagactcatgggcatgtgcgggaacgagggttggaatgcagctcgaatcaacgccgcattggcaattgcccaggagagaaacgcgcaatgggggtaacacaagtgaggtgtgactttctcatttgtggcacagcccagccacgtttggcgtgcgtgtgcattgcgtctacagccaaaaaaaactccgaaaatgagactgcttgccctgaaccactctctggcgctgaagatcagatccagggtccagaaactttgaatatgatcggtaggcgaaatagataaacagtcggggctccaaggggctagctaagccctgttgtcctggaaaaagctcgtggctgatttgggtggtaagcaagaatagcgtctggaatcgtcgattaaagctggcagtgtcgaatactatgaagatacaagcctattctccgtaggccaggatcatacatgtgcaatgttcctttttgatgatgctcaaaaatccagatactaccggcaaggggaaaagagaatacattctgctcgggatccaatggtgccaagtgatcaagggttggccattggataatacgcttgaatattcatgttgttcgtctgcttgctttcatgtttcatcttttaggccaggatcatatatgtgactccagagcagaactataccaggaccattgacgcaaactttgtcgccgtttacgatgattagtcctcgtacatgtgaatggcagctgccttgtatgcgcttacagtgcctatcggtccatttgttgaggacagctgctgatgcgagccagatgagtaattggattggctatggttttatggggtccactcatcgttctaacgcccagttgatgtatttgtctcgcgtggtggcgtgttgctccagcttgcgctttatcactgggctacgatgatagaagcagtatcaaggtcccgtccgtcagccgtcaaatttgaggagattaatgattgacggtatgagtgaaggtatcaaatagtcgcaataccgtatttcatccgaaggtgaaaaatattatgccgtagcgtgagccacaggcagctctagtgacatctacaggatcgtacagtcatttattctgtttacatggcggatctaaaaatactgaatgccatctacaactttagtttctcctaaaaacctggtttgctggtagcgccacgttgttccaagagtttcctattcagactgctcaaaccctgcgcgttcaacattttggcatccgacaccaccagctgttcatgcccagaactccagactaagtgcacagacatggattggcagattccctccaccttccacacgcaaaccgacttatcgagacaaccggttgctaagtagctgccgttttcattagcattccatgctatcgacatgatccccccatggaagtcactcataatagccaaacaataccctgtttcaacatcccacagccacactgttttgtcgtcactgcccgaggcaatctgctggccgcttggcgaaaacaccacgctgttaacccagtcggtgtggccgcttaggatggcaccaggtgcaccggtttgtgcgtcccagagccgcaccgtcttgtcctcactgcccgaggcaatctgctggccgcttggcgaaaacaccacgcttgtcacgtcgtcggtgtggccgctgagaatggcaccaggtgcaccggtttgagcgtcccagagccgcaccgttttgtctgaactgcccgaggcaatctgcaggccgcttggcgaaaacaccacgctgttaacccagtcggtgtggccgctgaggatggcaccaggtgcaccggtttgtgtatcccagagccgcaccgtcctgtcctcactgcccgaggcaatctgcaagccgcttggcggaaacaccacgctggtaacgtagacggtgtggccgctgaggatggcacagggtgcaccggtttgtgcgtcccagagccgcaccgtcttgtcgtcactgcccgaggcaatctgctggccgcttggcgagaacaccacgctgtatacgtagctagtgtggccgctgaggatggcactaggcgcaccggatagtgcgtcccagagccgcaccgtcctgtcctcactgcccgaggcaatctgctggccgcttggcgaaaacaccacgctaccaacagtgccggtgtggccgctcagcacgcatgtcctctcccaagtcgcggcgtcgtataggttgattgtgccattgacaaggcccgcagcaagtatcttcccgtccggagaataggcgcacgagtgtacggcgtgttcctcatcgagatacgggtattcgccaaatcgggcgtcctccatctgcgcatcgctcaaatcagtctgacgcagccaaatattgcggaggttggtgtctctcaaatccgctccttgcagttgtgccgaatcaaactgtccaccactcaagtctgcacctggaatcttgatacctctgagatcggccccattgaatgttacacctgcccgcaccaagatagtgatggcattcgctgctgcctgtcttgcgctggcatcggttttggatagctcgaggatctggaggagttttttcttgaatgtggggtcgctctgaacatgttcggccaaaaagtcgacaatcgatgactccttgacaatgttcgtctggccgaaagggtgaatgaggagattttgttcgttttcggctgtcaaggtctccactgcagtggcctcgtggatgtgccgagagtaaaagtactcgagcagcgagcgatgcatgaaccgatgttgcgtgcctgtacgtgacagtggactggactctcgtaaaagggccgcgtcaggtttgggaccaaagaacttgtacttccacgtctctttgtcacttctcggtgtgtactggacaacagggtttccgttttgctccttgaatatggcggctgcaagctccttcagaaattcaatcgcgcttggtgcaaatccctcctcgagcagctcattcagtgcttccctcgcttctgccgacaacgtcatgctttgcaggcggcatttgttgttctccaaccactgatccgtgaaagcattgtaagagtcagtcgtgtgactttgaccttggatagatcaactccgtccttgacaacaaggggcagcgctctcagcgcaagtgaaagcaggaacgattcttgacaagatccatgaggttggggatcgactgtagcttggccatgtagtcctccgtgctcaaaatgcgtcttatgcccatcagcttgtgtatctctggatctcgcacaaactgacagacatactccgcaatctggccaaccgagaacgatacaatgacagcctccgtgtacagactcgccgccttcccaatgtaacgatcagtttgcggctgaaactgattgcggtagtcttgtccaaggtaagtgcttctgcagctgataatcatcttgatgtctggctttccttcctggccgagattgttggctgcatgcagattggttttcagttgagtttcgtcgtatccgtcgcaaatgaggatcatctctcgatgcttcttcagctccttgatctttgcctctgcaaaatcgtgcattcgtagctgcttgtcgatcatatcctcatcaggagctttgatggccggcaggttgatgaacagcggtatgcgaccgccaggtgtatacgcctttcaaagctgattttcgaggtgccggttgaacgtcgatttgccagctccagaatctcctagcaccagaaacacctgttggtcgctgctgaggaacgtcgtgatcaaatccataagcggctccgcgtccttgtcagaggcttgaaggctggccttggcttgaggggggatatacaccttttggttctggctgcgaagtcgttttgccctgagttgatccagatcgcgctcgacaagagggatctcctggactcgagcgagtaacatagaatcctcaggcaccggcagacgagaccgcagcgggtaggagtaggccaaatgggcggcttcggccttgtcagagtcctgcaacaggattgtagctggtacgtggacagactgctcggtgttttcggtaatgatgcgaaagactgtcctcatccatgcccgtacgctggcatcttgtccccaatctgggtcgttgtcgtgcaattcaaccaggagctcgacagcctcgcggcggatggcactttcccacatggaatccactgcaatctctccgagtaactggcaaattccccactggaactcggggctctttcggcaggctgcctctaccacaaccgccttgaaatctgcaagccgtccttcttgaaccaaggcaatagcgcaaataagggctggataccacggtctcttgtttccagagttgactccctctttgatggccgcaaacactccctttccactgtcaattagcgatcgtgcgccttcaatggcggatttagcgatcccgaccgtctcgacaattgtcttttgcagctgacctagaccctcgaggaactcgctcaggttcagattgaccactcctgagatgccgattaaactttcagctatggcaccagaatggcgcacgatggcttggattacggtctcgtcgtctggaacatactgaagtgcctggaatgcgtacgacgcctggtacatcagaaacgggtccgagcttccttgcagactgctcaatacagcactcagtggctcgtgctcctcaacacggttcaagtcttcgacctcgtgcttggtcatgacatcgagcaaccgcgagaccgccagagtgaggtggtacgagtgttgggtcgattgcttgttcgtctgttgcagacggatcctgagaaggcccaaaatcttgatcaaatcatcggcgacgaggtatcccttggagctgcattggaccagctggacaagcccatgcagcagatcgacgtcgaggattgtggcctcctcgaacttgctgatgatgcaattgagcagcttgcgatagtgctcgtagtcaaggactggtccaagaacaacaatctcggtgacagcggcagatctcttgatgggatccttgacaaactcctcgaccatgcgtgtcagcaaccagcgaacatgaccctgctcaatggcgttgcgttcgatggccttgacccagtcatgctgcgcatcatcgacaggtgttttctgtgaggcttcgtttatctgaaggcggttaatctcgaggcttgaatcgtcggaaggggacgtggctgggttcgttgagagcagacttatacacaaggcgagctgaggtgtgctgtcaaagcgtccgccaaactttgggactgcggtttttgcagcaggtctggctacgtttttggagaaaatatccgagagggcctttgccttttcgatcgcacaggcctcagcgccgtgggcgacaatactagagtgggagctgccatggtcatatccagctttgatgctgacagaatcggcgtgggaattctttgcctcggacctgctagccaagggttcggcgtgagccttggatctatcggaatgaaaccagttgcggatcctctctcgcttccccaagcgctgcgacgagatcgacttatcgtcgccacggtcattgtggtcaggtgtggcgggcttcgattttttggtcatggtggatgctgcactgtaatatcatacatggagagacaagagacttgttaagcggttgctctgaggggatggatgcaaggtcaggcaactatattctatgatgcttttacctgttctcgtagcaattaagttctctgaaagaatcgagggtagcgtgctatgtgtctgatggaaaacgatgcggagacacagcgactcgacaactttgaaaactgtagccgaagttagaaccagcgacactagttttactcctaccaaagtcaaggactcccaaggattttcgtgtgtacctgagactttatcgtgattgctgttttaagctgaaccagacgaagactttgccaggcagacgctgatgaattcttggacgtgagagtggaggatgagggagagaagcagttgtgaggagaaagcgaaaagatatgtgtgatggaaaggaaggaggaaaggaatacagaaagaaggggtgtgggaacgatgttcggatgcatgctatgcttcaccatcttcatcctcactcgcctttgtgtaacctgagcaagattgctcggtcggccaggggtgcgcacactgaggaagcactgatccgacaaaattgatggaacgggaagaatacatcgcacttttccgtgatgcatgcatggtacaggcaccgccctcgtttagtcttgctcttcttaacgttgcgctccacccctctttctagacgtactgcactgccatgtgttgagtctgatgtcgctattctcgctgcttcttataaaatttgacgggggtactcgtgcctttgtcgaggctagaacagatgagtgatcttactcgatacccaaactgagaaggcaagaccacctccatcaaagcgcctcgctaagctgtttgctgagtcggcccctgaagacatggttcacatccttgtccagcgtccacctctaggtaatcaaatggaattgttgtgtatccatcctcagttgttgtgctatcaacttcattctaaagatatgctactctttgtctagtccacgcccttcgactgatgattcgcgttttaacgtacccagcctatcagatcccctggacggtcaatgtcaatacagcaacgcgagagtctctcctggcaactattttcaacgcgcttcctgcattgaagaccgatagtgtcaagctcactgtccattactctgtgccagaaaaccattctcagcggcactgttcagaagatttggaggaggacaacaagctgcaggatattcttcggtacaatcatctccacaacattcaagaattgaaactgctggtgtcgcatggaaacaaggcttttaaccagattgagtggagcgatcttcccaagttttggggaattagcgattacccaactttcggcattatcggacaaaccaacttcggcttttgtgagaaggaatgggtgtgttggtggaacagctaagcggcttcataaaaggcgatatttgtcttcgaaatgcacgggagttctcagcttatgtgctctcattccttgctcgagcacgaatgttgtatccggaatcgaaactcgattgcgaaacgccgctcaacggaagctatcatctgtggatcagagcaaggatgttgtcgtggcaataaccgctgtggacctcacatctgcctcagcctccgccacacctcccaaagcaccgcaggagaaggccacataccgtaatttggccgtcaagtcgaaggctgtgtaccagcctcacttcaagtttcagcgatggatggaaggtcagaagaaaatcgttccacctggcgaatccatctctatcagcgacatagaatgcggtctaccagctcttcacggggaaaacgcgagcgttatcaactatgtcaaggagcttgcgaaagtggacgagcgtcttgagcgcttttacaacggcaacgacatgatatacaaacggcacaaatgggatgcgaagcgggccaaggacagagagttcctcgagattgccaacagcttgttgaaggttgttggaggcaacatcggggagctacggaaggacggcaacaaggttgtcatcgcgacaggcctgggacaatttacaggaactccagggctcacgtccgtacactcgtctttcctaacctactttgtccgcaaggtaagatggttcgagcagcgtttttggcatgcgaaccgttctatttatcaagatcattagttggcgtgaatgagtattattcgagcaagaagtgtccgtgttgtgagcagtttgtgggcgaggtagagtaccgccgactgtgctgcaaacactgccgggcatattttcaccgcgacgttatggcggcggagatcatgtgcaatgtcgtccgcagctacttgctacatcagcgtcgtcccctctatctacaaccgaccgacaacaagggacgctttttatcgagcagcaatgacggcaaagtggcacaggacactagtacagcagcaggaacgtagcttatgtagtttttttttttgcgtggcagcaaccacgcatttttttcagattgtggcgctcgcccaaatggccgacgtcatttgggcgagaagtgagcgcctctctttgccaccagcatccccttcatccatgcctcactttcatccctcaccatcactcacgttgcttatacgcgccctcttttctcagctacacctcatcatctatcgttcttctccttcccttactctcttcctatcccttttataccgctctttctgtcgcttcatccttccttacatcacacgcgtctctctctcactctctcccccccacaccttgtgtccatctttctttcttgtcctctgtcactagtcacagcactactctcatcgcctttgctctcttcgacaaatcacatcagccggctatacaacaggtaaatgatatcatttcatttctgtccctctccctctctctgcctgccctcctctgcctcctggcttcctttggatcacaaccaaacgaagggcctcaggtctgtggagattgggttagttttcgcgatcattgccggccctgtggcatgctcttcatcagagcctcctacttggcagccaatgatcctgtcgttgctcatttgcacaccgcagtcgcgactggcaacgagggagatttctttgttctcgtcttgcctgccctcctctgcctcctggcttcctttggttcacaaccaaacgaagggcctcaggtctgtggagattgggttagttttcgcgatcattgccggccctgtggcatgctcttcatcagagcctcctacttggcagccactgattgcgactggtcaagagagaacgcacacatgcctcattggcggttttttactatctgtcgttttatatgtatgatcacattgggtatgcatttgcaacttgtttaaatcatcttcttgtctgtatttcttagtatctgagccgaaaatgtctgcttcaggaagctggcactctgagattattgatcgcaggaagggagcaggctattttctgtcacaaaaaggacacccatgcttcaaacccgttgattacattaaataccgcgcgttacagcgagatcagtcctcagctctgatcgatgaatggaaccgatggttgctagacctcaagaatagttcatatgaagtcgtgcggagggctgctgttaccgcatcggcactcacccaagatgacatagatgagtactaccgtgatcgagtctctgttgaccgcgaacacgatgcccttgaatcttcaagaaaacagcttcgagtgacggaccaacagcttacgttgcgtatggagaaacgccagggtgagccaaatggatacatggatgcctgtgaggaatgtgtttatttggatttacgatactaaaccagtggtacattacttttagtggagtctactcattccatgtcgtctctcaaggatgacttgatccaagaaattgcacagccagtccaaggtaaacaaacttgcatataccgattggttcggagattcatgcattccttatgcattgacttctaaggcaccttttgtcaccatgcgatccctgggatgaacaggatgaggtctcacttaaaataccccgtaatgaatcggtcttccccttaacttcaacgtcaataggctcgacaaccgcgaactccacaacgtcaaccgcaggtacttcagcggcagtcataagtgcaggaagagcaggactctcaagcgcaattactgaattgtcgctgctcccaaatgcttcaaccacccctcccggaacgccaccgtcgcttgctgcttcaccctcgcatctgggataccctcccccctattctggagctgctatcgactcaaacccctcagccactacagcaagcgtacttccaggatcccccggaacgtttccagccgtacctccatcagatgaacaatcaacaagtatcgatgcagatgaacgaggaattctcttatcacaaatcgaggatataacacatacatgcgcaccacaggaaggcaaggcttgctcaacttgcctcttcaagaactaccagcggctcagtgtggatgcccttgtgaaaaaccagctgaagatcacggagattgcagacgtggtatctttgataggggtattcgtgccctcaagaccaaccgaaaggatgaaatccgttttttcagatgatattcttcaagcgttcatcaaatcgggcgaggtgacaaatgcggagtgggactctgttgagttcaatgatagtttggctatgaaagctgttaaggtacgttcatcaattgcatggttcgcactcatttttgttaataattactaacgtcccccctcttttttgcagctctgcttgcaggaccggaaggacgatgtggcggcgactcttgtcgctatgaacaaggaccacaggcctattcgcatcatgcttgaaacactgtaagagttgttacaaagcgcatgatgctattgatgctgtgaaatcaatttaatttgtctttgtctcctttttttaggctggaatatctcccaaaggatgaagaccgttcgatttctgagtatgagtataccgtcaagcatattgggccagtcatgcaggcattttttgaatccaagaatgtcaccagccacttgtaagaatgaatgcgctgcaaaatacgttgttggtgtttggtggaattgcttttaaataatgtttttattattgacaaatagcccgaacaaagactcagcaacgcaaaagaaactaggactgaagcccgaccgacccgactttacggccgctgctggcaaaacagaaatcgcatggggcgagttttctggtccagctcacgagaacgacgagtggaagaacctttgggatttcttccgtgatgttcgctatggcaaggcctttttggactctggatttgagatggcacctctctttcatatcgtctacgagattggaaactacatgcgactaaaggctgaatcccgagggatgtatgtccttcatgaagtgggcaagttcaccatcccaaccacaactgccacggttgcctcactgatcgcaactttctccactctgttgatcgcaaaggtatgtattttagctgtgtttgagatttttttttgaagagattttcatattgaggttttgtaagttattctcattgagattttttatttctttgttgtagaaagacattgaggatattgcaaagggcccattcaatgttctcaagagatcttggggctacaaagacctcgaagaatccaagaaagctcgcgttcaacgacctaatcgcggtcaaaaaaagtaaggagattttcaatatttaataacgagatgttatggattgaagacaatgctgatattggtcattttcttctcgtctttgtccgaaaaagccctatctcctctgattaaaccctctgcacacatgctatcaagaaaaaaggttgcttactctcaaggtcgaaaaacaacatcatcaatgctcatctttccctttccttatgtacataccatccatataataaaagacatcaatcctgatggttagctttggcgcactacctaccagcgacatatcaggcaaatgcaactggggacagattctaaggtgcaaactgtgagggggagcgattttcacttatttttaaacgggttatacaaatttgtcgtgcgcacgccaggcacacgccaggagacacacgccgaagtccgatttttgtatttgcatatatgccaatgggaaatagacacacgccacacacacgccaaagtctgattttgccgtatagcggtatttcatacagcaccaaaaaaaaaaaaaaaaaaaaaaagaatctgggccagtcgtcctgtgtccggctcaagcgttgactcttgatgataccgagtatcaacttgcagcgattatatacgggaatggaagccacttttgctctataactatgatcaaaggtggcgctttgctttatgatggcatgaagcagagaaagcttcagtggctaatgtccaataagaaggcactggtcatgccggccggattccagatcagtcaggtttggtacttgaagaacaccgtgaaaggggttgcaccacctgttcaagaaaagcccgcagccggactatccatgaacgagacccctgccacctcgtcgcatcctctcgctggtataaaggcaagagacaacgaagaacacttaaaaacaaaccttggatcgaagaacagtgcagttgctacaaacgagctgattgtccccgagagcagactccaacgaaagcggcggcatccaatgggaatctccttgggtaccgttgctcggaatggtaggataccatcatgtacgggatgcgggaagacgttcaaaagcggttcccagagacttttgctcacaacagtcgtgaacgaggccaagttttggactaccacgtcgtcttttcatgtcgaagaggactgcatcaaagccatggaccgaaggtaccaggaagatgcaagggctttaattcaccttcggtagagattccgtatcaagtgaacaaccacgatatgcgcaaacctccaacgcaacgatcgggccgcaagaaagttatcagggagctctcatcttcgctgggtccggcttggaaccattcgaccccgtccaggaaaaaaaatggtaaataaaagaacccgctttggcgtgtgtgtggcgtgtgtctatttccctatttgcatatatgcgaatacaaaaaatcaaactttgtcgtgtgtgtgtcgtgtgtttgtcgtgtgtctattcgcatatatgcaaatacaaaaatcggaatttggcgtgtgcttctggcgtgtgccaggcgtgtacacgactaattctgtacactctttttaaacctttccctaatctatacaactttcaacatcttcaacaaagcctgaaaaggagaaagaaaagatggaactatataggctctggagccatcactactccttaacccacgctcgtaatgaacataattgcgtcctttcaatattactttcggtgctacgagtgagaaaagttcactcatgagcgacgagcgaccgaaagggaaaaaaatcttgtcactcacttgtacgttcaaatgtcgttgtgagcgacgagcgcgaggaaagaaaaaaaaatccggtcgctcatagcaccgattattagtcctgcgcacaggtttgttttgtccaatctcatatcaatctcacacaagacctcctcctctttgacaagccgttcttttaggacccctgacccgcaacaaccctctcaagatcactcacaaaggctacaaccgtcgctcaatcttccatattcggatcgctctttcgccagttgaaatcccgcgagatgtttctgaaagcgagcgttatcgttctatcgatgttggcagtatcgacccgaattctaatgaagagaggattgaaagagccgacatcgaaggatcaaaaagcaacgtcgctatgaacgcatggctgccacaagccagttaatctcatgtccttctcaattataacacggatagacgtgttatcatcagtctccattccataggcgacgcgtttcgcttcttgtcgtgtctctatactatggccgcttctccatttcattctgactacctatctctccctcttttttgcatccttccttcctcactctgcccttgatcttgtttttgacatccctttctcactctgcccttgatctttctggcattccttctttctcactctgcccttgatctttttgcgtccctcctttcacaatctgccagtgcatccatgatgtccttcttcccgtctgtgcatgagtatttttgtatcccgtctgtgcgtgattttttatgtggccctccactgattttttttgtgttcctccccttcatgccttggtgagctcatcccttgatctttttcatgccttggtcatttcctcatcccctgatcttttgtatgtcttggtcttttttgcaacagtatatatatccgctatgctacagcagtatgactctactgcagtagtagtaggcagagccacgagatacggctaccgcagcgatcaagatgatactctgtactgactattgagcacagacactagatcatacacacatatatatagagcatccctccccccttcaaatacggcagactttgccttcctttattaaaattcatatacattagaactccttgacttcctcttgctgcagacaaccaagccgagtacttcgccatcgtcgacctccaccatgattcctgggtcaagtataccgccgtcaacctggaaagcgaggctaaggcgtcgtggagatcatcaggcctcaaactcgatgccaaatggaaggactttgagacagcttttactgcctacctcaccccgcccaacgccgtggctgcagctcgacaggagctcaacaatttacgccagaaaggtctcagcgtgaacgagtacacgcataggttcctacgcctgatccctgccatggatgcacagacggctctgtacatctacactacaggtttggaacctgagaccagcaaggaggtgcgcttgcgtcaacccgagacaatggaccaggctgtgcaccaggctgcgatcgtgcacgccgtcttgcatcctcagggtccccctgcgaaacccaaccctgccctggccgcacccgccacaacaaccgacatggaggtggactcactcaccactgtgatccatcacatcgaacgactcgttcagacccttggacagaactcaacgttcgttgccaacacacgccgccccctgcctaagctcacccctcaagagaaaccgagattgatgaagattggtggttgctacaagtgccgtttgcgaggacacatcgccgctaactgcaagaaccccgctaacgcctcctacaacgtgcatagtgtggagatggagacaagagacgacgacgcgggaaaagcctagggcgagaaccgaaccactgtgttctgttccagatgcggtagttgacgcgacccacaaatatccgttgatcgaaagtcttttttttttgtggtggcaacttggtaggggtggaaaaataaagaacaccttgatgcacactctctcatgctttcacaaaagctgtcgagctgacctcgtatttcataagagactaatatgtgcaaaagctgtgtcatagggtgactttctaatggctgtgttctgtcaagacttggatcccagatcacgacaatcccgctgcacatctctctacacaagggacgagggcttgatgactatctgcaaaggcactcttctactagttagcaccctggactagttcttgtgtatgaaacgtaaaaggtcctttacaatccgctccctggcctcaagttggctgtagaggcatcgctgacctgcggatcaaagtcatgatccatctccaggttcagcttgagttaaaacctttgctttgaaaggactttttgttgacgttttttagaatactaccttcgaccgccattcagtccgcgtctgcgtgtaccacgaagagggcgttcgcatcgcggtcttcggtgctttggctcctcttgcgcgttcaagcgtcattcaagaacgggctcgtatccgcttcccgaggaccgcctctggactattccagcagtcgcggttgactcctttgattctgcgactgtactgattacaaaatttgagtagaccacgcttaatgagcaacatggtcgccatcgacggagggcttgtctgtactcctcacttgttttgcgataccaagcactaatccaggactgctgaaaaggaaatccggcgcgatatcattcacgcgagtgcggtcccttatggcaacgtggctatcgaatttgccctaacaacatgtcgctgctgcgatgttgagacaagattacttcaaaggatgttgaatgcaacgcgagattcaagattccttcgtgcacgctggaccacgacatgattatcacgttcatggcttataggtgcggactgctaagtgtatgtggaaagaaaaagaaggtggcggcaatgctggatgatatatgcatggtggcagttgacggctaggtccgtcgatgactgtgatttggaaccttgtttgaagatctaagcatggtaacggatcaggccattcttcaaccacggagccggtgggagcacagagcaaggtaggaaagccctcagtgatacatgccgagggtttatcagcgcgtgcagatagagagatgattggtcgatgagacgatggcgccaggttttctggctttgccctttccgcgctgagtgctctcaagacgcaggatgcagaagaagtagagataacgggactttttttcctaattctccatacgatgatctgacacatgttctatctgggtcaaaagtggacaggaatgttgttgcagttgcatctgagcaacagggtgggcacaagcaaagtagacgcctttgacccactctcatcatcgactgttcgtccccctggaccagaaattgtggcctgacatggcaaggcacagggacagccgctgattggctgcatgtgggtgccccgcaaccccgtcttattgcacggcagtgtgcagttaggaaggggaccctactggccttcttaccccctcaacgacccgcataaaaggcacggcggagcaggatgcatccgctcttgcttcttccatcaccctcattcacacctgctccacatcctcaccagccatgaccaacaccaactctggtacgggtgcactttgctctcctttctctctcttgagccagcagcaactcgggcgagaagctctccacacgcaaacagaaccctgatctctctctctcctgatatatccttcctctcgcctgcatagtctacatcgccgctgtggcccgcacccccctcggatccttcaatggatccctggcttccttctcagccacagagcttggcgctctggctgtcaagggtaagcaaaaactcgtccacgagccacagcaacgaagagcacttgcagaatggtactcttatcaatttaaaccggatcgtgttcatataggtgctttgagcaaggttgatatcaagcccgagcagatcgatgagctctactttggcaacgtcttgtctgctggactcggtaagctaagctaaactttctcatatgttcaataagtcggtggagtcgccatgccaccagtatataggcaaagacattcgtcgggcagctgtgcgttatttcaaacccccacaactttatattcaggcccaacaaaattatggttactcagtcaaaaaccaaccagcagaaggacaccaggaagggacagcggaaataagtgagacgaaagcgacagcatggaacagctcttggccgttgaggcgtggacgagtgaatgaaccctccagatggactgtagcgtatgggtcgttactcactcgatgccacttttttcacatctgcaggtcagaaccccgctagacaggtcaccattgcctcgggtcttccccagtctgtcgtctcgaccaccgtcaacaaagtgtgcgcctcctccatgaaggccgtcatgctcgctgctcaaaccatccagactggccaggcggacgtaagtctcgatactcgggagattgtggtatagcttaaaagcttctcgcgctaaccacaaacgtatttttatcgcctttagatcgttgttgcagcaggtgccgagtcgatgaccaacgtcccctactaccttcccaagatgcgcttcggtgccaaatacggccaccaggaggtcattgatggtattcagaaggacggccttacagatgtttacaacaactattcgatgggtgttgctgctgaggagactgcagaggagcacggaatctcgcgtgaagctcaggatgactttgccatcaactcttacaagcgtgcccaggccgctaccgaggctggacttttcaagaacgagatcgttcccgttgtcattcctggagcccgtggaaagcccgacaccactgtgtccactgacgatgaaatcaccaacgtatgtctcgatcgcagacgatatgatggaggaatatcggacatggagatgtgtattttcgtagagtacttgacgttaacctgtcatcacttttctacatttagctcaacgaggccaagctccgtgccatgcgccctgctttcaagcccaacggtggcacggtcactgcacccaactcctcccccatttctgacggtgcttgcgccatcatcttgatctctggagccaaggctcgcgagctcaacatccctgttctggccgtcattcgtggatccgcagatgctgagcgcgatccttcaagattcacgactgcaccttccttggccatccccaaggccatcaagcgcgctggattgaccgccgaccaggtcgaattctacgagattaacgaggccttctccgtcgttgcctgcgccaacatgaagatcctcggcttgacaagcgataacgtcaacgtcaacggtggtgccgttgccatgggtcaccctcttggatggtatgcgtcgacttggtacatctggtttgcaatgatgatatcagtagctctttgatgcatccattaacattctcgtcttttgtgaatcatatagctctggcgcacgtgttatcgccacattggtgaacgtcttggaccagaagaacgcaaagatcggtgttgccgctatctgcaacggaggaggtggagcctcggctgttgtgattgagcgtgtcagcgaggaccacgccaggctgtaaattcgaccctcgacaatatcaccacccctcatcacagaaaaagataaagaaatagataccacacggacacccatctccattacaaaaaaaaaccccctccctcaacactgtttatagtttctcattaaagctcgtgtggagatcgacctacattgacagacggtgcttctttggtaattgtaacgtcctggtcttggcggtactctatgtgaaaggctggggagaccgctattatgaacgcgccttcatttaaaagtttcgctcaaggttaagcgattccggcaaaataaaagttgctttcgtgactagttggtatcaaagaagcaaaggggttgagcgcacgacgagaagacaccttggctgaaattttttcctgaacgctctaaaacgcttgcatcttttggtgatgttggtgaaggtataccagctttcaacggcagaaacagagggacagcagtggcacaccgcgttttcctctgtcacacctgaatgctcatggcgatggcttgcgagaatggcttagaaggagacgagcatcgtgcttgaaaattgtcagcatactgacaaatttatgtcgtacaaagcaagcctttttcaaattcccctggcacttttgcgctcatggcttaatgcgcgacggacaacgaacccaccggcgctagaccgccatatgatgtgatagtctttcatgctcatcacctcactccactcaatcgcgagcccagcttgctgccatgtacagtgcgtgttgtatctgctcattcgtagctgttggtcttgcgttgtttcgattgtttcgtgcagtccggaagcgggatacaaagcctaacggtgttagtggatctggacttgactttcgcatgtcagccttgcccatgccaataatggaaccggtttgttcgtgctaacaatgtagtgcggcgcatacacggtggccgatagaagatgacagattctcatcgcccagtcgcccctgacgcgatatataccgcgcgagcggcgtcttgcaacggacagggcttggtgtgcctctcaacgttgtaactcaggatacttgcagtgaaccagaaagatgagggtcctggataaactatcgcgcatcttgcatcaaacgaaagcaagacgcattgctttgtaggtttgtaagaatattttgccgaacagccgcactgacacctttgctctacaagagctgctttgctggccgacatggaatatggggcctacttatcccgatctcggtgactggctgttgtgaaatttcaaaaaaaaaaaaactaaaatgtttttcagccccatgcgatatgcacgttcaaccatactgtgcaccgctcttcatcaacttctccgcttgattttcgcgctgcgcctcaccactgcttgcccctgctggtgccaatcgatccagtagaatggcagaccactgtttgcatactttcctacggacccttagagatcactagatgactgtgttcagcaaaggacaggcatctagagcgtgtcatgcatagcactttttcttttggcgatgctcgacatccgcataaatatcgcgctggccgcgctccataaataaggtatcacagcagcagcaagcatttcctcaagcctcaagcacagatatccaacccccccccccctatcaagtctaaacatgccttccatccagaccgtgaccatcgccgcccttctcggcctcgccgccactgccaacgccctgtgcaagcccgccgttggaatccgtgttcagaccaacaacaactgcaaggtcgcctggtgcggtaccggaggaaactgctcgtacatgccctgccattacatcaccgtcttccacaacgacggatcgtccactggtggctttgagattgcaggcgccgctcagttcggtcaaggcaagcaggatcagatctacgagtgggcctactttggcagccaggacagcaagggcatgagcgtgttggccactggctgcggtggcaatggcggcaacggtggccttggaggcatgggatgcgatggtaacgccgtcaagagaacgaaccgcagcaagcccggtgtcagcagagtctactacgactgtggaaaggtccccggcgtccccgcctaagctgtcaagctttcataccctctatcacactcctattaccccacttttcaccaatattaaaaagtccctgtccttccggtcattacaaaaggaaatgaacattgttgcaacatggagtgcgcaacggtagactaatgaaagtcgattgtggtgtcactttgttgtcgaagtgcttcaacatatacgatgcatgcgacgacatcgtataggtcaaaacggaagaggcgcaagcccataggctttcccgatacttgaaaaaggctgttatgaactggatggcccatgaggggcttcttggggttggcacggtatcaagtcgtagccatgatgtgcatagcagcaatccttgaagcgctgtgtattcttgaccaagtcgtcgccgaaaaactcaacaaactacaggaagtagtttgagcaaaggcacgagtggacaccctcgtgttgtgtgaaatttgcgtaacaaagcgcggtggcctcatcgtcgtgatttttgccgatgttgcctgaacacctgtagattgggtttttgttcgaacagaagaacgagaaggccagtgcgagattcagaccgcacccgaaacgactagtaatcttgtatacatgatctgtaccagatgaagtattgagcgaagaaaaagaaaagaaaagaggaaatccccttgggccgacttcttatgagcgtatgaatcggctgtcacgatatcatttttcaatagcgcgttcgctccacatggattaagcgtctcactgttaaaaaatggaacagcaggtcgtgctgccaaatcccgtaggtgtgaagatgccgtctgttctgcatacaaggtcagaatcgtatggtcaagacctgcctttggcctatcctggcagcgatgtgatctcggtgtgggttcgtgtcagttcaggaccctggaggcgcaaatgaaactgattctcaaaacaaaattattcgctccgcgcccagagcgctttccttttagacaggtctgtgtcaagccaaatggatgggtgtaaatgaataggtgctctttccggtgatcatgttcatcataacgaccggggtacctacaaagttcgaatgctacccccctaatgtcataggtgttttactcgacctcaacaagactgggaagatcttttattttcattggtcgctcacattcttacaggccgtagccgctcgaaggccctgagatcacctatcgcgggcaagtccttgaaggagctgtcctccttaacactcgcgcatggcatagttcttgaatcccgtgcagcaattctgaaagtcgtgtttacgctgtaggatggccatccctgaggacgtgtctgcctcattgagtccagcgacatgaacaaaatactctgccattctgaagcagtagcactcttcgagcgtcctgttcccgtaactgcccagttgcaatctgcagtgggaggtgacgaggtagtcgttttctacctcctcagtcatgctgacgcatctgtacgagttgtccgaacaggcctttgagaggggtatcaccgcgagaagtaggcagcatacgagcgcgacggtgaatctgacatacatgactgcacccaagagaaaacacaacggagattaagaagtacacaacacccacgggctaacgaagcgcgtagaaatccatttgttgcttactagggctgatgaagagtgactgaagggatggataaatggcgatggaaaacgcgaaatggagcgatggttactatccatcaagaacaagcgaaagcgccatcatcgcaggggggttttataggcaaaaggtggaattcgcattaacgaatgcaatcctgacattggcccttatgcgtcgaaacaacggcgtataaccctagctcggccgttcagtttcctgttttgggacaactcggaagtgagcggaggatacatgcgtgtgccatggcggtaggtacactttacgcgtcgccgccctggccggagaaatgaccggcttggtcgcgtctttactcccactttgaaagtgaatagcggcatgattcgcagtgaaatgcattgtaacagcccttatgagacccaattacactagtgtggcccgtagtttcattgctgctcgatgtgatggtgccaaagtatgccgagtcaagtccaggtggtcaagaatgcacaaaatgggggcgtatctcactctaactgtacatcctgagaccatctatggaagccaatgaaggaaatagtttcacccaagtgagggatgggggtgcgcgatggataccatagcactgaatcatcggaaaagtgttcatggtggcggcactcctgcagtggaacggcgcttccgcgcgaactcaaatctgtgtggtgttggctgaaaatacaaatcaacatggtcgccaagacagcttcagcgtgagttaattttcagcgcattatgccctcacatcgacgcctagataatatcattaagaagtcggagctgatgaagttggaagagtttaaggaggaggatttattttgctctgtgctgtgctaatcaaggcagcatgagataatgggataaagacatcgagcgtctgcgaagcagaagtcctggcaaataatgtgacccagggacgagagctttacttagtcggggcatatgcgcatcgcatagttttcgtgtttgctacaacgcctttgaaaagtatcagcgcgcatggcgctgtccgttctgatatcaggatagatatagacaaagtcctcggcccaccggtcgcaaccgcaccaggccattgtcatgttcccgctccgactcagctccacaaagcattccacggtggtggcatagtcctcgctaacgctcttagacggactcacgcatctgtacgagtacgagggacagcccttggaaaacgagatagctgcgaaagaaagatagaaaatgagcacgccggggacacgcatggcgagactagaaaataaaaggaatggtttgttgacagcagtgttaggccacgaaaacatgtaaataagtgaagcacatagctacttacagttgaccaaagacgtggacttggataggaaagtgcaaaggctgcggaatgagtgaaagttgttttatgtcagttacagaacgcgagaaatgagtcgccattttataggcacgcagcatcgtcgctttcacaaattcagccctaataccagcgaaaacgcgctcatcgaacttggcgccggttctgcatcactcatttctgtggatacatcaggtgaatacatcaggtggatacatcagacgcggaaggtaaatcatgaacgttttttgccatagccagcaggaccaagacacaatacttctgaactgtgctaggggcagcaccgggttgctcctaccctgtctgttattcatcaagggacgctgaacgtccactcacccaacgcaaatgaccgggatatgagaaatgcattcattgtcttttatttttgaaactaggcattagtactgagaaatgaaatcattagtgttgagtgtgcggaccaaagaccccaagtgccctctaaaaagccgactgacgcggctgcgtgttgtatcccatattattgtccaggagcctatgctgcccctgttgttcctgcttctgatctggctgaaaattgtacgcctgctgcttttgcacaggctgaccctgataccctgctggacgcgtatggttccgaatattgtactccaggcgatcagtcttggggccatctgtggacgtgtatcgcccactgttgctcttcatcggtgtcacgtaacgactaatatcccgatccttgcggtatccatattcgtcgagttcatcttcgtcctcagagtcatagtaatgatgggtcgtgtacgttttcttgacccagagtacagtctcgccattatcagaagtcggcgctggagtcggttggtgtgcatgagatgcttcgactttgggttgtggcggcgggggaacataggcggccgagggctgtacccagtctgttttgggtggctcgaccctgggttcaacaagcttggacgtgatgaccggaacggccttgggggctgcctggaccgcagggggagcatcaagcacaaaagttttgatgggttctggctttacgggcacttgctcaatgggctccaccagttttgacgtgaaggttgggacagccttggaagtcgatgcatgggcagctgctggtgggttgatcacaaatgtcctaacgggttctggttttgctactgctgccactgttgccgctgccactggcacggcttggatgacagtcgtggtcttgatgacctcaggcgccactttggactttctgtgcaaggtgggcatgcgaacatgaggcattttaggcgccgagaacttgaacatcttgggcttggagatatgaggcaccctgggtgctctcatcctgggcatcaccaccacaggcatgactaccttggggaacttgaggtccttacccttgacaggatgctctggaatcatgggccgaggcgcagtagtgactttgaccatggaagtcgaaaccagcttgggttgcaccttgggcaccacaggatgacttgcagacgaaggatcaggcttgacaacatcgtcctcagtcagtcgaagaactggcggagccgatagggtgggaaccggtttgtcgacatcatcctctgtcagtgttaacctgtggctcacaacaggcacggtgggcttttcaacatcctcttcagtcaaggtcaaaagatggctcactgctggaacaaccggtttttcgacatcgtcctcggttaacgccaacttgtggctgacctgcggcatcggcggtacgggcacatcatcctccgtaagcaggagaacgggcctctcacccaccggctggcgttctttgtatgccacggcagcggcagagacagcagcggcagacgacacggcagcggccgtaacagcagcggcagagtgtgaagcggccgacgaaacggcagcagcagagtgtgaggccgcggaggagacagccgcagcggacgacgaggtagccttagagatcctagtcttgagaggcaccttgaccttcttgaccttcttcttcttgccatcctcttcctcaacctcttcatctgtactctcgatcacagctgtggtggttgtggattcaatgaccgcaaaatcaccaggttgtcgggaggttgagccctccgcctcgtctgcaaacacaatagcctttgtggatgtcgtctgcacggtcatggcagcttgttctccagcgcgaatgactgcggcctccatgtcgtcatcgtcctctaccacagtagtgttgttgtgaacgcccttcgaatgaacggcgaaatcggaagcagggatcatggcttcagctgtctcagagtccttaccgacatgagttcctgccgatttgacagcgagttcgttgtcgtccacagatttatcagcaccattgcttcctttcctaagcagacggctcatcttcctgttatgagacgcggcagcaccggcagcgacagcagctgtagcagcagcagatgcactgccggcattctttgtgatagaatgcgttgtcgtagccttgtcggtgaccaggatggtggagggcgtggttgagactggttcaaccttccgggctgagatggaaccgtcatctaagaaaaaatggggtctcattttagtagtcaagtccatttcaaccaaggcaagacaaacaacggcgcaaaaggaaaaacgttatgaaaaggccacataccctgagtgtcacccggttcaggagtcatcgagcgaagtgccgcagcaacgcccgctgctcctgtggcagtgacagcagcggcagtggcagccttctttttcttcttcttcttgctgttcttgctgctcaggctcggcatgtggagtccaccgagggcatccttgaccttgtcggtcatggtcagatgggcgtcatgatggccatgcatatctttttcatccagctgaatctcctctgtcacaccagtggggtgcgccggtggtgcagggttctcatgtctgtcctcctctcgatgtgagtaggcaccctcctcctcggggtagaggctcaaatccgcgttgggcttcttcagcatcgcggcagtcgaggggcgtctcagctggttgtgaatgggcgaagtctctgaggatgccaaacgtgatgcttcagcagctgcatcataagcaggcaccgaagccatgaccaacggcgcaagtctgtggtcagacgacgatgacaccgataactctgtcaccctcgaggggtgggctgaaggcgcagggttgtcatggacgtctttctcaccccgcggataagaaccttgctcctcgtcatagagcgagacatccgtcttgggcgtcggaagcgcggctgctgtggagtggtgcgagttgcgacccaggctgcttgtggccgctagagaaagaggcactgcggcagcccctgtagcggccattgctcgggttgatctagagttcatttgattgccggctgagatctgcggtggaggagttggcacatgcgaacgtcgcaggctaggaggcgcgaaacttggaatctcgcgtggcgtggactgtcgcttggagttgagcgactttgagtgcgtgagatagtgtccccttggcatgttggaggtgtgccaggtctcctccacgtgaacggggcggtcttggctgggtgagaacgaatgtatctgcgggctattaccagcgccaggtctctgcggcgacacactctggatctgaagcgaggacgaaggagtgacaatgggtgagccaacggccgagatggtcgaggatgttgtcagagccgactgaggtgggggcagatgcgagcgcctcatgttcgctgggatgtatccaggcatcacccgcggtgaggagggactcttggcactcagggactttgagtgggtcaaatagtgtcccttcttgggcatgctggccatgtgcagactctgttctgcctgagcagtgtggtcatggctcggtgaaaacgagtgtgctgagggaccggcctctgatccaggatgctgaagtgctatattcgaaatcactggagagtcgttggatctctcggctttagagcgttccttccaatcggctttgtaggccttggcgtgatccttgtagccgtagccaaaggagagcggtctcgccttggtgggcggctttacctttttctcctttactggcactccaaagccaaaccaagttgttctcctgttcaaggtctgagagccgcttggggtagaggtcgcaccaccaacatcacttttagtaccagtgccgggctcgggtccagcataaggttgatggatggtctcgatatgttcagaggcttgactctgccgcgagggtccggtgtaagagctcaatccatgatatggcttgtgaatggtttcgatacgagtggccttgtggtggtcgtgatgatcctggctcggaggagcggaaggagcgtatgtcgccccagggcgttctccagaattacgagagtcatgggcatgcgaggacgatgccgccttgtgattgaatgtatccggctgtgtgaaaaatgacccttgaggtgcgtgatcttgcttttgaatagcagatgggtcgtgatgggtcataggcgacccaaactggcccgcagccgctgctgccgtgcctaatccagcaagtccggctgcaaccttcgcagcagatgcgtgagtgccacggtgctttgaatctcctcgagtttcggtaccggggccgcctccagaattgtcttcgagatactctagcgggccactgaagcgctcgtggcgaggcagctccccaatgctgacgactggctcgtccaatctctccgacgaagtgtgatcacggtgactctggccatggctgtggactctttcgtcggagctgtcacgtttagtcgaggggaacgctgtagcatgcgatgcctcaaagtgcaatgccttttccagctccggaggggcgtctcgagaaagcggagctttgtgatgggagcgggtgcctgcaaagtggatggaatgagctggagcagccatggtgtggctgtcttggtctcctgtaccgattatacccccttggtctccatggctacccgcaccagctcgatcgccgataccgatcatacccccttggtctccatggctacccgtaccagctctatcgccgataccaatcatacccccttggtctccatggctacccgtaccagctcgatcgccgataccaatcaggccgccttggtcgcccgtaccaatcgtacgactttgttcaccgataccagtcataccgccttggtcgccgataccaatcattcctccttgatcagacgtactgttgtttccggcatgagtgggctttctaatatggtgcggcatgacagcgtgacgagggccagcagagtggacgagatggatctgctgcccaagtgcacccgatgcagagccactggtcgctccttcgtctgatccagagtacccgctttggccttgacccttctttttcttcttgttctttttcttcttggatgaggatgaagccgtggcgcctgcggcagtggcatcgagagcgcgcgtttcgtgggattcatcccagcttgatgacctgttttcgttcacattgttcgactcgcgtggcccatgagagttttcagagggcacgggagccccggtgccttcagactggaaccgtgacgagaaatgatggccaagggtcggactgtcgcctccgtcacgtccgactgactggcgcttgaaaaacgacgaactcaggccatagtagggcctatggtgtattgatcaagagagaaggtcactttgtaagaactcgccatgataaagcccaacccatttgagttgaggtaaaccattttacctctcagtttcagcgggattgccttggcctggtgtcatgtgtttggaggcaccactgccgacactagatgaacaacctatttcgtcagaagtcttgcagtattgacaaggatcatcctagaaagaaaaagagtgcgcgcacttaccgctgctgagtgtttgcttgcgcactcagagatggcataccggcatccttgtattgtgtgctagggttggccgctggaggtagaagtcatgaggcgtgtagtgcgttgatgagtacaaacgatatcagaacgccatagataaaagcctcggcagctacacaacacgtacccataggcatggcctttgcttgcatccctccatactcggccatggccacctgagactctgcagccgcagtgttgtgagtcgacatacggacgggtgagtgtttatgcgacaaagtctcgtcgtgggaaagcatggtcgagtcgtcgcgctcattccgagagtgctgtgaggcgttgttcgacattgcgtctgttgacttcttgtgggtgctatccatcgtccaacccgacatggcgtttggtcaggcttgtgcgcgtgacgggtgagtgggctgacagtccagtgcgagagttgcgcgatggattgaagagggctaggtcactagttgagtgcttactgagcgatggctatcgcggaaaggtgaaggcgaaggatatggtgagctggtgagcagggagagtggagaagagagcaggacagaggagtttgggtgacggggtgagaacaaaaaaaaatgatcggcggaattggaacagcaaaaattttcgcgtgtctcagcgcgcatgaggcgaagggaaaaaaggttttggatcgcgatctatggttacgacgatccaccaacgatccaagtgtgtctgtatttctcgaacccctttacaatttctcttgtatgacttgcccctgccaaagcttcatgaagcctcatcaagctctccaaattcactccaagctggccaccgcatctgcagaagttatcctatgagctggtgattgcatttaacatccgggtgcatgcagagatgcttgaaaccggatccacctcgaccactctgtaccgtcatgacactcccatcgaatacagtgcggttcaggcgttgttggaggcagtcaagttcagctggtctttaaggactcttgtcttgaaggaggactcaattggagataacgaagctcagacgttgtccgaggcgcttaggaccaactcgactctgaccactttggccgtccagcggaactgtataagggacaaaggagctcaggcgccgtccgatgcactcaagataaactcaactcttacccatctggccctgtacaacaactggatcacagaaaacggagctcaggcgctgtctgaggcactcaagtccaactcgactcttaccacattgagattggacggcaactcaatcggaggcagcggagctcagacactggccgatgcacttgaatgtaactcgactctgacaactctgaccgtgaagaacaactcgattaaagacaagggagctcaggcgctgtccgaggccctcaagaccaactcgaccctaaccactttggacttggagtggaaatggatcggagacagcggggcccaggcgctgtccgtggcgctcaagaccaacacgactttgaccattttgaacttggaacataactcgattgcagcaagcagaagccatgcactgtccgccgcactcaagcgaaacgcgactcgagtaagatagcaaacatatctactatacgttttttgatgatatataaatagttaaacaagaatggagatcggcaaaggaggaatgaggaacgagaaaggataagagttcaagtcactattgcaccttgcacgacaagttcaatattctctgcctgaatgaccttgtaattggtcttgatttctcgcggctgtttcacggtactgtttgaggagccagccttttttcctctcgatgttgttaaatggatgactttgttaagcattagcaagcattggccttccgccgggtattgctgagctgttgtcaacgccttcatataccaggtccgtttagattccggaagtagacccgtcagggatatggctcccgacccatgagtactctctaggcaactgcagatcggctgacacacctcttgcatgcagcatgtgcatatggttaagtactctatttgggagtcagaaaagttatgagctgaccctatgacgattctcctctcgatagagtgttcaagtatgccagcagggttatattacaaagacccttcttagcaactttatccagcccatgaagagcgcgtccgtgggcgaactacacattcccagtagactggcagcggatagcggaacgaccaaaacaaggctgcatggagcaaccccgcctctctgagttgagagctatccaggaaatcgtagagcactgagcatttagggtacagcagccaggatacatatttctgagaatttttttttttttgggcgcccgcacactccctggtcgatctgataagaaaaagttgcgcccaaccttctcgcgtcactccctggcgctcttctctgatcactcagaaggatcaaagtagtgaacctgcatgcatgaagtttaatatgatggggagagtaggaagcggggtggagaggaagagggagacgaagacgcgggtaatcaccgatcctaaaaattgcggtgttgtacttaagcaagagaacgtcccacgtcctttccatttttcttttccctttctcccttgtaccaccttccttcacccagtacccaccactgcaccctagcctttacctcatacctcaactcccaccctggagacagaccaccttctgtccacataccttctatccatcacaatacacaataacgaccccacacttctataccatcatggcgaaattttacatgttactggccattggagctgcgctcctgttagccgtgcacggtgcccctcacacggtacagaaagacactggtcgagaatcagctatgaacatttgtttttttactaacacaaggtctacttcgtgcgattagagagtatgccgcacatctcagtgccgacagactgccaacagcattttgagggacatgcatccgaaagccgacccatgtgttgactttaacaagttcgcctgtgagtcgtattttcttcctccactgcaatctagaaagtgctagtcatgcctcgatgttagtgtactaacataaacaacatctgttcgctaggcggcggtttcaaagaacgcgaaaaactgctcgagggcgaaaagagaaacgactacctcaccttcatcgcagagcagaaccttgtaagagactaaagcaaaaaaaaagtgttttcatgtcaaacatttcccatccatggctcttcccctcatgttcatggtcgttctaatcaatttttttttgtaccacctctttgtgtcacaactcttctcacgcaggaacttgtccgcacgatcgctacagccaagcatcccaaggggcccaaggtacccaagggcgacctcgccgaacagcgcaacctcaaaaagcttcaatctttctacggcgcttgcatggatgaagcccacctccaaaaggtcggccgcaagcccctgcaggacgagatccgaaagatgaccgagatctacccgggccctcacagcaccggtgttcctggcggcgaccgcgaagccatctcaaagttgttgggctgcaacatgaagaacgggttcgagaactttttcgggttcgatctctgggacgatacggagaatcatggacacaagatcatgacggtgcaacagacggggttgggccttggagaggatgctctgtactcggatgagaaaatcgtgaagctgtatgagagggtcattggacagatgttctatatcattcaaggcggagccgatccaaatgcccgttcgatggtcgtccccaaagcttggaaacaagtcgcaaaggatgtcgtggcttttgagaagatcctagctggaattgttgaacagctcgagcccaaggaacccgagcccaaagtacccgagcccaaggagaaggaacctaaagagaccgacaccgacgaggacacgcccgaagaagaagaagaggaggaagaagaagacgaggagaacgatggcaactactgggacaccattgaggacttgacagcgatgacgcctgccttggattggaaggtgattctcgagactgctttccccaaggatgttgccatccctacacagtttaacatgctgtggaagttttacctgaccaggatgaacaaggctgtcgaacagtccgcacccaagacagtccagaactactttgcgtggacactgatccgtaacctcggcaagaacttggccgattcattccagggacctctcaaggaactcgcaagagcccttcccggcgccaacacctccgtggcgaccccacgctggaagacctgtgtcgagatcgtgaacaataacgtgggtgacttggcagggcactttttcgtcaagagcatctttcccgagacgtctcagaagcaggtcaacgagatgatcacctcgatccgctggagctttgaaaagaacttttggcaatatgactggctcgatcctcgcactcgccaaaacgcgctccagaagttgaaagcgatcatccagaaggttggctactcgaccgtgagtcctaatgtaatctcctccacctcgatcgacgaatactaccgagcactggacattcaaggcaaggaccatttcggtaacctggtccgggccagcgcttggaggacagagatgaagcatcgaggagtgcatctgcccgtgaaccgactcaagctggaggccatccctcagacggtcaatgcgttttataaccctacgcagaacagcattgagatcatggctgggttgctgcgatcgccgtttttcaacacgaacgaccccgaatacctgaactttgcgggcattggacaggtggcggcgcatgaactgggccatgcatttgataacagcggacgcagctacgacgagaccggtgcccttcgcgacgtacgttatcggttatttcgacttttatcctctcattcatgttgcatgtttgttgcctctccctcatacataatatttttctcgatgatattttttttttgcattacaaactagtggtgggagccctcctcggttgaggcctttgatgaaaagactaggtgcttcattgagcagtatggcaattacacgatcaagggccctggcggcaaggaagccgtcgtcaatggctggaccactcttggcgagaacattgccgacaatggcgggatcaagatggcctttgaggcctggcgtcagcgttaccgatctgatcgcactggcaagaagtatgaaaagaagcaacacaaaaatttttggatcgatagatggattgtaatagtttttttttgagatcgatgctgatccttctctcgcacctccaacttttctctccctctcctcctcaaaaaaggtacaacaatgcccgcttgcctggtctcgagcgctatacgccggagcaactgtttttcatccagtttgcgcgctcgttctgcggtaacatgagcccagacgagagcgtacgcatgttaaccgaggatagccactcgcccaaggagtatcgcatcaatggcgtaatccggaacttggcctatttcgccagtgctttcaagtgcaaatctggcacacctatgaacccagtcaacaagtgcattctctggtaaacgtaaagaaagccctcagcccatgtctgtgaaattgagagctgggcgatgcaaccagtagaaattgcaagacatctatgaggaggagcaatagaagcacgatagacgactttttggttccgtttattgcagttaagcatgggcacattgtggaggcatcgtaaggagatttgtaaaagtacagggagcggaggggggaaaagcagcaatagaggcggtaggtgtattggtacatgtggataacgagagatagatggagatagatgagagataaatggcgagagatggagaggatatgcaggtgaaaaggaaaaacaaaaccgggcgtcaaaggagttatggattccatcttttacagaggtgtgccatcactgttaaagagcccttcgatgtaggctggatgcagctgcttcgagacatacgttctaataaaaggggcgaggttaaggtcagtgacttgacatggtggtgaactttggacacaaaggcgactgaaaaaaaaaatagatcatggccacgacttacgagaaggtacttttaggggtccccatgaagtaacgtcctttagcagagacgacagcatccaccattggaatcaggtccttgctcaagcccacgccgtcagtgtttttcatctccttgagctcctgcaggtgctctgagaaatcgtccagcgtaaagatgcaaggaaagtgagcaaagagtttccggaacagaatgttgcgtcgaggatagacgccatccgtggcaatgtagatgatggtgtatttgccgccctcggtcatgcgagccctgcactctgcaaagtccagccgctccagtgatgctctggtctgcaggggtggactgccgcccgttttcgcgtgctctgtctctggcgcggcaacgacggctgaggtagtagtcagtgcttggtagtttgcgatcggggtgatgccggtgatgttgacgaggttctggaacatgttctcgatattgtcgggcgcaggctccacaaacatgccatcgcccacccgcaggtgcagtcccacaaacgtgcccagaccgcccagcttggacacaatcgcgtctgaggtcttgacgagaatgggggtcgacaggatcatggtccgacgcaggaactgctggtaggccttgtgctccggcagctctgcgaggacacgtcctgtggcgaagagcgagcccatgtgaaggacacgctccggtcgatccgccagctccttgagttcgactttccgcagataccgagccgtgttgagtggggtcgcgctgttggggttgtcatagatctggtagtcgtagtgcgccctgtcctcgatgatgtacacgtccttcttcctgtcgatgccgagctgtgcctccatccaggcgaatgagtgatccggcctatgcttccacggctgctccttgcgaatccgctccatgtcgtagaaaaagtcccattcgaccgtggtccaggagtagtagttgagacactctgccggcagagggtcgcccttggggatgcgaccacagtgctcgaggccgcgcttagtctggagcatgattctgcgcaggagaatgtcgaacaggcgccattccgtggctggacccaggaacactggggggatcagcagcgtgcggttgaggtactttgccagcaagaggccgttctcgagcgtgatgcgctggttgtggaagccgctgtgtggcagataagccagataccgctcgttggggtcgtagctcggacgggggacaaggccgcgcgccgaacccctggggtccgtttgcggggggtcattgtcgttggtgtcagtcagggacggattcgagattgaactgacatagtagtagaacaggacgaggacgaggtttgaggcgaggatgaagggcaggatcaacctcttggtttggatcagcatcctgcttcagggcgcagaggggagggatcgcgatggggcgtggcgatgtcggaagcgggatcgaggacagcgaggacagcgaggacagcgagaatgaacgagtgtgctgctgtgtgccctgggtgtgtattgatgagaaatagatggaaacacctttacagggaggggtgcgaggtgtgaggtgcgaggtattaggtgtgagaaaagtggagagatacaaagggcacagaagcaacgcggagtatgagcaaagagagagaacgagggagaatgagagagtgagagagaatgagagagcgagagagaatgagagagtgagagagagacaggaagggatgatcccatcccgtcgcatcccatccacacggcgctacgctctctccatccgtcctccgcccttgctcatcaacgcgcacaacaacacacaacacaacacacaccacccaaaagcagcgcagctgctggtcaactctctcgctaaaaatagctgggcgcgtgggttgcaaagaggcgtcgttcctccgtcacttgcgctcgctcgtcgcaagcgtccatggcgaatccccctcctctcgcagccgcctgcctcggcgctgcaatggcaatgcgatgccatagacaggaagcacaggctggcccaccgtcttcctatgcgatggctcaccgcgatagcgtttggccatcaagtgcaactcactctggcctcagccccatctggacaaaggcacaactggacagctggacatatttttgagttttcgcacagcccagacccttggggctgcttgtcattagccagccacctctttccatctgtccttacaggaccaaaaagctcttccatagctcttaccggggccatacctcaatctagcctgccatgctcactcttgcctgccatgctcaggcccatctctttcctaagtgcagcccagaatcgatggctggattgatggatgtgagacaaagaaacacaaagagggaagtaacagtgggacaggcttaaaaaataaagtgctctcaaaaaccatgagagctttttctccctctcgccagcaacactcgtagtctaagtctgtctcgtctccactgcacattcactatcgagtctgctgcgattatgaccatgcggaataccgaggatcccgtgcgaatttttttatttcagctctccttgcatgatcgtagacgaccaagtccatccatgagccacgaccacgagatctcattcgcccaagagcgggcagtccatgcagggagatcaaacttcgtgatttcatctcccactcactctacagtccccgttacgcatttcgtgtaaaatttcaccaaatgcgaatcaatggtggcgtctattgtaaaatcgcgctctgcttgagtgatacccgacatggatcgtatggcaaggttgatgtgttcagggcatcgctcttgcgacgtttgaatagtcgccaccattcatttggtgcctgccacctgccaatcaaattcacggaaatatagcagattcgcatttggtgaaattttttacacgaaatgcgaacggggactgtacatgtacgcttcttgtagaaaacactgatgatatttaaagttgagatgcggcgtggagcgtggctcgtggagcaacaatagaggctgttgttttgtgccatcctccgcgctgaaatacatgccaaaaacaatattcctgtgtcccctcaggaagcctcagcggtcgcatcagttttttttcgtatctattggacatgaactctttatttctacctgatacgcatttgagcctgcctgcagcgtacctgtgatcgcttaaacatcactcaaggcgaggtagagaacttattcctcatccctcaaggccatcaatgtaaaagatgtgggtgtgccttagtcctcagttcaggagctcgacaaaccaggtgtagcagaggtgcctgatcacattggacggcaacaccgcgaaaccgcccgttgagaccaagtcaaggagttacttcgacattgctcatccggtgtacaacggtttttttactcgtgggtccagagagaatgctgccgacctgggcctttagagttggacgcggacatgttcggggtacatgttttgatgtagcactaccttgacataataacactcatggccaacaaagccagatggcacctctttttatgcaacgttcgatcgcgacgataaaatatggcttatgaaatccaaaacttcgccttcatctctagaggacctatcctggtcactcgtcagcagcacccgacaagctgccaattgcaagacgtcctctaggtcggtctgctcagtcagtagccagggtatcttctctatggttaactcatatggctctggatcttgcggtagtcagtttgacccagcaaacggtgggaagtggaccaacattggcctaccgtcgttccctttcgcccaatgaacgagagggcgttatgttctggatcgaaaaagccgcggcaccccttctgatgcatgtctatcggcatgttaccgacaggggcgatgagcttctagcctcgccctttgatagcacaacgaagactttcaccgagccctccgtgcggcccattgcagtaggtctcgtctctattcttgagatatatgtttgtttcctgatccgaacggcgcttgaataacccatcacccttgccgccctgaatttgctagggcaacgaatatgacattgatcttgcatttggtggggacaaactgtatgttacttcaaccagtgatgagcctaaggaaatcaagttggtgatcatacctatgaccaacggaaccctcccgtcagatcgcacgtctgtaagtcgagacaacacttggcgactgcgaatatgaaggagctctgactgaatgattctcccgcatctccataggataacgcattaatatttcgtcgaaagcacctggtgacactggaaggcagtactttcagctcagtagtgattgaaccgaaggatggttactctgatatcgatttcaatgaaccacatccagttcagttcgcaacagtgactccagaaggacggacaccgacctcggcctttagatgtgatgacctctattgcttcggcttgtcgctcaatggagacagtgtgggcgtattggagaaatcgtttaatgcactcaaactttcagtgcctaacgggtcctatgtgcccccactggtaccctaccagttcacgtcgccacggccatgttgacgaacatcatcattgtctttatcactctcttctgctcgatgggagaccctaggcacagacgagaagacgctggctgaagtctagagtaggttgacccactgcgtttgaggtagaagacagtagaggacagtagaggcgctcttttcaacgaagtaacataactttatctggtttttgtgcagccatgttgatgaagggcctcagaatcgtcaacatccacagtgcaccttgcaccttgcattgtgcgcgagcatttctccacggctgcggcgaacgtttctcgatcggcgcactgaccagctggcccaggttgaggcgatgcttctgatttggcggtgtgaggacgggcagtcgagtgagggctctcccgaaatagagtgtgtgacaaagcgtcattcctcgtcctctgattccttccatgcacccgtctctgcacaggcggacatccaccctcgccgcacattcacccacaccactcgcagcgatccaccatggccaacactcacctcctgggcccgcgcacccatcgcctctaccgcggccatcgtgccaaatcgctgaacatcactgaggaggagctcgtcgagattcgaggtgagctcgcattctctctctctctggcctgtcctcagtttgcggaggccccacaagctccgctctctttctgctgattgctgtcgaattcccttttattttcgtcactgttgtcaaaactaatgcttcctgcatcaccctgcctttttttttcttcctcttcttctgcctaccgggttgactcagcacgcgagaggacgttcgatggcgcctactggcgcactgccatgaaggccttctccatgggcatgatcatcattcgactcttcaccaaatcattctacaaaatcggcatcatctttgtcgcctttggcatggccatgctcggcatctcagtcttgaggcgcaaggcagcaggagacgtctttgaccagcgccaaccgttcgaaaccagcgggttctgggttctcgtcaccacgttcgtcaccagcgttacctatatcatcatgtttgtcatgatcatgaggatgtagcgacatattggcttaagcacgggcggagggagttgtggcgctcgctgtgacagacaatggagccagtgctttggagtaggctcatcaatgccgataaaggaacgctccatgaccataccttggcagagtgtgtggcttctgcactggacgttgaggcccccctcaatgtctccttcttggagatggtactaagcttgagaggctgccaatggctagttcttgatcatcctattggtaccatgatataaacggcgagtatgttggcgtgatgggtcttgtaaataaagaaagtctggatatcgactcgataagcgccatacacgaagaaaaagcagtgcgatcgagtatccttgcagagactgaagcactgcagtagctgattgttctcgctcgtgacttgtcgtccttagcgaagggatgtggtacaattcaaagtcgccccctcacctctgcagtccttgagctggtcttccactgtgttgccttcattgagaggccgaatcgtgttccatgcctttggtacaggttgcatagatctcaactcgctttcgaaagtgtgctccacattacgaaccggtgatagggaggttgctataacccaatcttgaacccacacgctgttgtcaaatcccggttcccatgtatgagtcgctaattatgatctcggcctatgttgaagcactctttgctgcatgccccataaccacgaaccaggtaggttttattcgttctcacgatcgtatagagaactaggcgggactgaaaagtatcgtaaatggggaagtcaaggagacaaagagatatttattctgtgccgagcgcaggactctaatatcggtgccttgccgcaggttatctagacacttgatgaacttggaagtggtctctctagaaccttacaggtccggtacaccgagaggcattggtctgctgtcctctgtcatattcttcagcatggtcatgagcgacaagaattcctgacagttgagcgcaccgtccttatcagcatcgaacgcgttgatggcgctaatcgcctcgtcgttcgttaccgtcaccctcagggatgcaaggagcttcaaaagctcctcggtactgagacgatcgtccttattcacatcaaagccttcgaacgttgccctcaaaatcttcagcgagtcttcctgaagcggatgaatgactggagtgctggcctagagcaaaagttccatgaggcatatgaaggggtggtgatgagatcagtcgttactagggtgtaagtcatctgggcaagttgttgaaggcgatgtggaaagcaaagagttatgctcaggaaagcgtccctaccatagtggaaatgctgaaagttaagagtgtgggaaaaatgtaaccgattgcaaaacgatacggtgtggtattttgaaggcgacgaaagaaaacaatgacctgcctgcaactttgcacggacccagcggagatgtgctcacaccacatccttcgttgatttgaggagtgatgttcaggaaccaaggcgcattttaagacaaattcttggtttgacgtgatcatctcacaaagcgaactttctacgctatatcgagtagagcttgctgtcatggaattttcttcaggcgtacttgttcaagagggcagcaaatgaactctttattcgttcacacgacccggctggccacctgaggatgcaagcccctctaggcctcttttttgagatgcaaggtcgcccacagcgaacagacttcttgaaagttgagcccacgatccttgtcagcgtcatgctttttgacggcctcttctgcctcatccctcgaaatacttctcttcatatccgagaagacatcgatgagctcaatagtcgtgatacgaccatccttgttcttgtcacagtctttgaacgctttcgtcagcttttgcaactcatcctctgtaagttgaaggtctgctttcacgttggactagtgtaggaacgatggaaagagtatgaatatgagtggatcggtgcagatgacacgagacaagggccaagataaacgttcaatggagaccactcaccatgatggacgttcggaggcgaggagtgtgggaaagatagctgtgtggtgtggtacggtttagagagcgacgagaatgtgagataagcgtttgtagttatatgcaaagcacgggcctcccacctcctcatccttctcgcaactctgtcttgaagatcaagcatgacatcttggtcatattggaaccccgcgatcgcgagcctaaagtcttcctccggtatgtcggtgttctcgctcatgacgacccttaagatcttttcagtagtgagaagaccgttaccatcttcatcagcgcccaaaaacatggtctcgagccggtgctgctcatgcttaccaatgttttcctgggttttgaagtgcatatggacgggtgaggaagaagttcaacaaagccagaagagattgtgattgtgcaaacttacatagattccagcggagcaggatcaatactcagaggaggcttaccattctagatattcgaaggttcgagggtgtgggaaaatatggttgttgaaagggatgggatgtggtttggaaagcgacgacgatgtcgaggagacatgcgactttatatacctaatgccatgcggctttatgtgtgaacaagaaacccagatggcgcgatgcctctctgacctccttcccctcgtcgttatcatgcacaaggctagtgcttttgcctttactgcaatatgatttttcattctttgcaaaagggtcggtcttttcagcttcactacctcttgatcagctgcaacattgctagactatataccatagagggacaggtggagttgcaatagctaacatctcaaaaggttcgcttgagaaaagaaatcaaggcagcctttgcatagctcacgggtcaaaagagtcgactttctgcccgcttcttggcctcatccaacacctggacgtaccatttgggaccaaagtcgtgctccagtaaagtcgacagctgtggctcccccgatagctcgctttgctcctggccggcctcccctctgcgtctctttctcttggccatctccgacacacgcgacgaggtcggatccactgcatccaccatcatccggacctgatttttgtccaatgcgaacttgcgcagcccctcgcgtcttatgaaatgtctctgcttctccatcgcattgtacaccttctccgctgcaaactctagcatcttgtggcccacgtcgattcggtccagcaacggccagactgcctcgggcggcctctcaggaccttcagggtcgagcttgtacgactggtagatgccttgctctaaacggtgctgcaaccagtcatcgagagcatccatcttgtgctggtcgtcctcttcctcttcttcttcggtcatggtctcttcctggatggatttgtccaacgcgtccaggccgccaagactgcgactcatcagcgtctcaccctcggggcgcgtgtctcgacgacgtgtgatgcgtgggcgacgcttgacttgcttcaggtgagccttttcaagactggggtcatagctggtgcaccgatggaaccaatccacagcctcgagctccttgaaaatctcgacggggtcgcccagtcccttctcgatgtagatgtggcagatggccgagtgctccggcaggaccaaacccttctcatgcaggagtgatctcagcaggtttcggcgcgtcttgatcacatcgtcctgaggttcgggaaccttgcgacctgtgtactcggagtcagcgcgggctgcagcgataccaatgtcaccaccatggacctgtcgtgcgagccgaagcacgtactgctcttcaaagaggtacatgggcgagttgtgtcgaaagtacggattgcgacccatctcgtacggaagcgacatgatgtccgagttggtgagcaggtaggccttcatggcctcacccttggtcatgcgtggcgtgaccgtgtactcgccgtcctgataaggggccacgtcttcgggcatgggctctgggtgctcgatataatagtcgactcggcagtcgcgacacatgcgtatctctgtgggcacagcctcgcccaccagccggaccggtagtgcgcgataggagcctgaaggccggcacagcttgtagcactgctcacagatcgagtcggcgttctcgtgcgccagacggtagtagttgggattttcgtagccatactttccgatatgggtcccagagagggccaggccagcggcctcgcagatcttttgccacacggggaggtggtagatgcgtttgcgccattccttgctgacgccggcgggggcagtcagttgcgacgggtagaggtgcgaaaagacgcgttgccacagatccgatccaagctcgtatttgggcccgctctcggttcgttcgagctttgagggtgtgggggtcgaaggaggagaggatggaggctccatcggctcaccactgaagggggtcgtgcccgcaggaccgccttgaaccttgtacttggcgcgtgtcatcgccgtgtccgaatccacatagccgaccttggcgctggctccgatgtgacctgcacggctgcgcttggcatgggtcgagtggtcgtcgtcgccatagtcgttcttgttgttgtttccgttcgagctcctgctcgcgctcctggagcgggccctgctcgtcgatgcgggctcgccaccagtaccggtgcctcgtctgcggccaccacctacagcgacctcgcgttcgtcttgaaccattttggactcttcttcggggggttcaaggtcgaggatctcgtggaggtccttgcggtgctgttcttgttcttgctgctcttgagcgggatcacgcttggggaggttggcgatgatctcttcctcctcaaggtattcgagctcctcgtcgatggcttcttcgtcctcagggttgggccggtactcttcgtcgtcgtcgaggcctttgtccgtgtcaacgacgatcagttctttttcttgaagttgttcttcgacttcgtctctgacggtggtcgctctcggtgctctgctttttcgtcgtacgaccataagccctaggagaaagaaaacggaaggcgtagagatagagaaacttgagttcaacggtgtgcggtatgggtgcgttgtgatggatgggggcaaagggagtgaacgcgaagaacgcaatggaaaagaggtgggagcgagtgtctatgagatctcagacgcgctcgtttgacgctgatcgtatgttctaaccagccaatgaaacgcgtgcatcacattcagctggtggacccgggaccccgccagcgtcagaattacgacatttttgaggtgcacaagtttttttattcagtttttcttcgcactcgacatacggacatacgggttcaaaaaaaagtgatctggggttcgctctgagccatgatcatccggatgactcgacattgtggagtagcgaaaaaaggtggagtaaaagaaatgcgcagaaagtattgagagatggttttctcctgttgaaaactgaaggcctcgatcgagtttcgctctgaaggatcggggatcaccatggtttggtcactggcgacagagtgaagacatatttacagtaggcgccaggagtaaggcaaagtccttagtggcaggtgcacttgccagcacaggtgcagtcagcgctggagctgtatgtcgaaggagaaaaaaaggtcgcaaaacaaaaagtcagcggatttgagagcatggtgacagaggtgatacgaatgcataattccgaaactactctatttacctggaggagcacccgcagtccttcttgtcggcgcacttgcagtccttgttgcagcggcattcaccgccatgctcgccctcgcaggggcactttccgcgagcacagccgcaaccgtgcttgtgagcacactcgcagttcttgtcacacttgcaaggggcagatttgccctcgcatgggcaatcacccttgtcacacccgcaggcgttcttgccgcccttctgggcgcacttgcagttcttgtcacacttgcattcgccgccggtggagccctcgcaggggcagtcgccacagccgcagcccttcttggaggcacagtcgcacttgccggcgcagacgcacttctcgccagagccagacttgcagttgcacggggcgctcgacgaagaggaagaggactgacccgtgccgcactggcactttgattcaccgcagcctgtgtagtcaaaggcgagggaagaggggacggatgatcaaaaaatttagaattagtattggctgacgtgaaatgacgccagatgacgctgtcgccagtgagtacggcgtgaaagcagaggaaatgaacgtaccgcagttggcgccgcaggtgcactggctgtttccgcaaggagggttcatgttgatttttttttgtttgggttggttggtggtgggagtgggaagagtgttcagagtaggtttggctgtttgtgtgtgggatagcgggtcgtggtgggtgaagagaacaaaacaacgaaaaacgaggggagagcgcggcgttttataatgaggtttgctattgacctcattcacaccgaatgcgaattcccaaatggcctcatagtcgaagctgtcaagccctcgccgatgcgcgatttttgccagagtgacagctctgcgtgtgccggggaagatggcatttttatttttgcggcatttcgtaaatgaacaccaccgtaagacatacccaccctgtgcgctcttgtgtgcttgggcatccccttccccttcgccgtaggccctttctgctactgttactgctcctgctccttgcttttcgccagatgcgattacaagatgcgaatacacccccaaacatgccaatggtgacagatgactaacaggcagcgtcgagccctccctttgcccctataggtcttgcgacgtcgttccaaacagtggacatctgatcctgacatttcacgtcaaccacacgcttgggagtcatcccattggcaatagagtatgcaatacaataaaaataccacaagccgagcctgaaggcatggtattcttctcacatacaacgagctacatatttgcccggcaagctcatagcctgcgattaatgtacaggtacatgaacacgtctggcacatgtactgtgtgccccgaccctctatcgccttggccgttttcgttcaacggttgttgtggaccgctttgatctactttgatctcctcaatccgctccgtgcgccatagacctgcgcctaggccctcgatccattcgtactgacggaatcgcgagtatgagacgacgcaccaaagcccgccaggctggaggaccactcgcgcgacttgctcgcacagcgtcctcagttttgtgcactgatcatcgtcgccgcaagagatggcgtcggaggtggatttatcgatgcacagcgcaaacgagtgtgctgcgagggctgtcatgtcaaggcagtccatctccaagaaccgaagagggcattctgtgtccaaggcagagggcgcgagcgatgtcttggtagtggtgtcagcagttgctgtataaggactaggccatccaatggcccgctcactccgctccttcaaccgctcgacgacagacccgacgaaatcgacgctagtgacataagggaagcctgactgatacaaatccaagggcaggtcagagttgccgcagcctaggttaaggatccgggctgtggggtcggttggcaggagcgccagtgctcgcatgcgcggctcgaggattgaccacggcatgagccattcgaacgagtgctcctttgcaaagcgctcggaccagtagtcctgctggtcaaagggaatggcgggcggcatatgccgaggcaggtggactggagagggggggggaatggacgaaagggatcaaggcagctatgcgatgccaatgtgaatgtgaatttgaaaaactaccaaaaacattatggccctgtgtggccagggcaccgagatccggctctccacacacctgctccacttctgcacacctgccaaaccaacccagttcaaagttatggccaaggaaaaaataaaaaaaaaaaaaaacaattagcaaaggtgtgcagccagtaacagtcactgcatgaaccttattgacgtcttttttttgctcgtctttctgctgttgccctcgacacctctctcccgccaccaaccttgcatgtcgccatgagccaggacagagccttcatcgacccatccgacgtggtccgcaagaagaacggacgcatcgacctctgtacgcgacagcgccttcgtgtctcattgccgctctgcaacacacgcgcatgcactcgacacacacgacacgcgcgcgcagttggtccgtggttccttttatcgtctgccgagctaacttttccgtttctctccttctgcgctccttctgctccccttccgctctccttctgcttcactataaccctatggcatttggcatagtcaataccattctttcgcggccggattccaacgcccagataccagtcctcgacagaacaacttccacttcccagcctctgaccgccgcgtcgcttccactctcaaaggccgagtccaccaacgacaacgaccacccatacccggcctcagcgccccacacaaccactgctcagtcaaccagtgcaagcgacagccggaaacggcctcagtcgccatccagtaccgaggcaaacgaaccacatgcggccaagctgatcaagacatccacttcaagtggacccaccgggcatgcaggcggagccggaggacgcccgttcgagagagtgtttataggctactgcgcacgaccagagacgattcctgccggcatagcgtactggcatgacgagcagcatgtcatcatcaaagatgcatatcccaaggtaaaaccagcgacgtctcgattgcgttccgattgacggaagggcgatgttgtgcatgagtgacatatggaatgctcttgactgctcaacacccactttttttttacgggttttaggcaaaggtccacatgctcgtgttgccgagacagcgcattgacaaagtcacggatctatccggtgtgggcggcatccggtttgtcgaacaactggtcgagcgggcgaaatggcttgtagagaggtgagagagacatttgtaaagagaacatggggattcgactctcactttggagttatctggacgatcttgccaatcgaataactgaccatcctctcttgtattgggttatcgggactgtgtaggctgaaattggtatggcctctgctagaattcaagatggggtttcatgccatcccaagtattctgtaagcaagcttgactgttaaatctcgctgaatgacgcgcaagggattcttttctcctttttttttttttgtttagatgctaattccccaactttgccgggatgccgggcctttctgaatccgtaccatgaacacgatagacaactgcatttacatatcatatcgcaagaattttgtgcggacgcattgaagaaaaagcagcactggaactcgttcacgacgccattctttctcgacccgcagtttgtcatcgacactatcaagaccaaaggatccttttcactcacagcacagcagacggaagattacaaggccatgatctccagagaactaaagtgcaaccaatgcagtgagaaacccaagaacatgccggctctcaaacgacacttgcaggtgcacttcgaccacaaagtgaagcagaagcaacagcaggatctagaggcgggtttatggaaatgaggcaaggggtgtctcctggaggagaataccctcagctacccacctcatggacatcatatctgcaataaaaaaaagcaactcgacataggaagggcatgagcgcatgagaaatgagacgtggaactgagctggggcccgagagcgatgagattctaagccagagcgattgatacgaccttgacgtcttgaaaatctcatctggtgttttggctaaattttctggtctctgtctctcgcctcattccctcgctcatctcatcaacacttggtcctctggcgggaccgtctattttcgcctccaaggcggagagaagcacacagaccgcggtctgtgaaggatcgatagactgccatgtctcaaggtacagtagaagccgccctacaaatgctgcatttattcagcaagtggtgactagatgggtatgtgagcagatgcacggaggtttttttttttattctgagcacagtctactgatattaggtggcattaggggagagaataaaaatgtactaatcaacaccatctcttctttactggctgtccttgatgctgcggtcgcacaggaagctcaggtcagggtactgaggagggtcaataccggcagacatggccatctgacggaaggcaatcatctgccagaacatctgcatgatctgcgtgtcctggggcgtgaacgtatgggggacatggctgatctcggtcgtgtcactcttccagataccgcccaagaccgaaagctgtcggcggaccaagagcatatcctctgccaacttgaagttgctggtcacacgactgtagaccaagttggcctcgcccgtcttggcatcaccttgcttgcccaggaacaagaaacccatgttgccggcctgatcacggtacatcatgttctcacccgtccacgtaaagttggacgagtaacgcatacccaccagcgcactgcggacatcgccacgcttgggcagctctgcaatgttggccaactcctccatcaaggggctgagatcgttgcgggccacgccgttgatcacgaacgaatccgcatggaaatcaactgcgtcgaaaccgaggcagacgcgtctctgaatggtcttggtcatgcccgagctgaaggccttggcgaccttctcccaggtctcggcaaaggcaccaatggccttcacgatcatgtcgatagcagcaatcacggcaggcagagcacggggtgcgagcaaaagagccttggagttgttcgagagcgcaagggcgctggcagagatctcgggcaggcgctggggcttgggcttgggtgcagaggggctaagctcgggggtgagggcattgaggtaaccggtggcggtgtcataacgaagaatgtccatcatggccttgtcaatgttctcggggtagagcgaccagctgttgaggtactgcacaggtttgaaggaaccatcgggctgaacagacgcccagcggatgactgcaccggtcgaggtgctgtcggggatagaggcgctggaatccgaggggtcgttgagcatgtcgcaatcgataaagttgacatcgaccttgttctccagaagcacaacatcaaaggccttgttgctcgtgggcgaaagcataacccaggagtagctggtggcggtggtgacgttggagctggcagtgcagttgtgtctgggagggctgatcttatccttgcgctggctggcggcagagcactcgaccgaaatgggctgctgtctcttaacaaaatcaccgttgacgcggttccaccatctggtaacggactccttcataccggcggccttgaagcactcggccagtgcgctttcaagcacattgtggaccgacgcggttttgacgcgcaacttgatgttgttcatggactgatcacgggcctcggtagcctcctggatggcctccaagagctcgtccttgtggttcttgaagacgtccttgttctcgacgttgttctcgatgatctgctccagcaagttctccaaggaggtctgctcctcctcgaccttggtctcgacagagtacatggaaatgggggcggacttgggtgtctcgaggtcacgggggacggggacatgatccagagcccacttggactggagagagttgaggacagcctcaatctcgccgagctcctcaatggccaagcggccgggctgctgaatgctgtcggcgcctgatttcatgtaaatatgtccgagctcaaccctgtagacctcctcctctgaagcatcgagttggacgcgtgcggcgacaatcaaggtggtcaagcaaacggggcgggccttgtccatgcacttgggcaaagtgtaggtgaaaccacgagcagcgtagataccctcaccaatagcagtgtgaatcaggttggtgatgctctccaaggtctggttgaacatgctctcgtcaataccccaggactcgacgacgggctgaaggttggcggggctgagaatctccatgccggaggtaccgttcgtctctggggtgtgcatgagacgctcccaaccctcagggcggctaccggggtcgaggctggtggccaagtcgtggaggagggtgcgggggtctccgccctggaccacgttgaaaggttttgagagtgtgttgacgggggcgctgagtgcggtgccgaagaggcagagcatcaccgcagcgatggggatggctcgaatagagcacagcattttgtgctttagtaggcgagatgtgatcttttgaacgataaagggtgatgatggtcagcatacactaaaaaatcaaaaagccggcttaagccgccttgaaacacatgttggtcatgtatatggtaaggacattttgcatctcgcgtaaaaaaagaacttacggagaaagtagcaagggagatgaagcgaacgcttaggaaagaagaaaagggggtagtcgtgatggctgaggtgtatgaaggtagggggtaggagcgggtcgcaactacaggtagagttgcagggaggtgaagtgtgaatagcttgaggtgacaatagtgcacttggtgcaggtatatatagtggaaggagaatcgctggaggatgctcacagatccattgtatcaagactgacacagactataatgttcgcccactccaaaaaagcagcttgctaaatggtgccatggcagcatggcattcctagaaagtcgtgaacttggtgaagcgtgttcaactcccacataaaggccgtttgcttaaacgctcccatggtctatttcacgccttgtcccgccaagtagaatagagtacatgtagacgatagcttgcacatgtccctccttgtgtccccccagaaaaataaggtgtggaacagacgctctcaggtttcgaccatgcacctccataatttgagcatcagtattttccctcaagagtacttcaaatgttgagctctcactcggccccgtttggggtcgttgttggccccaggaagcatctgtcccgcactatagcgcagaagcctataactataaccgtagagaatagtgagacattcatgaacaagaatgctcgaggactaaaccgcaaaaggcatggagagctctcaagcattattttagatacgtcgatggatttggcgcgctgcgaggttgagcaacaagagcgtggagcggaacgaaaatgcgcactcgtgaccccccccccccctcctttgtactttcatagaagtaactctaatagcgaggcgagtggcgagtgtcgaccgaaacgtgcgccagatgcgcgtgacgggaacttcctcgcgccaaaggtacctggttacaagtactgtcattaaccatgcgtcaacgcgcagactttgtgctcaacatggcggcaaggacgggtgtgaaagggccaaacccgagacagttgagatgaatgtggaaagatggatgcgggaatagacgagtgcaagtcttgctgagagaatattctgcggcgatcttgagggtcaagaagacaagcactttttgagcttgcgtgcatgcagtacgctgaggctcttgctccgataactaatgtgggcgagcgaatagagaattgaaacccaacttataatgcataccaggccccatgtacatgtaccgaatatgcatgcagagtagagcccttgcgagaaaccgtggatctatgatgcactgagtacctgtacatggtagcaaatactcagacataaccttgtgtgattgggatcaaatatagaacacgacggtcacttgcaccgcgattgtgcgcagacattacttctcccccctatccccggattctggcgtcttttaaccttgactttgcatttcactaccaactagaactaacgtacttgcacctgatccagaagaggcaatttctcgctcacgaggctagtcttcatgctctgttccgcccgcattagtgacggcgccatgatgaaacctcacagggtttgtagcgttctccagcaaatgcacggttaaaatacgtcgtgaagggcgcgcgcaacgatgaaagcatatcccaagttttctttcacggtagcctggtaccatcgttttcgagctttatcggcaaagacgcgtttgtcgcattgacaagggcagatcggcggacgaataataatcgtaaagatagactgcatgcctcaattttactttttggggcagtaagtccaacctggcatccctggtattgaagctcaccaaataaagcgttacggctttgtcatatctgtccgcatttggacccactactctgcataggtatatacttgcatcgttgtacttttaacaatactttctatcgcaactgatgtgcaaaaggatcgtcctccctcgcaactcccgccatttggataaatctgcagcacttgagccgtccaaggaaatcaagtgtattttttttttagcgctcggccagtgattgttgtgaggggggcagccgatacaaaggagaagagaacgcgcagttgttcgatagcattcaaggacgctgataccgcctgccagcacctactgtgggctgaagggcataaacatgagccaggtcatgtctgctacggcaaagagtgaaataagggggcgcattgcagcagcccttgtaccctcgtctcgatacaagtataaacgtgagaaagaagaggtttttcgtgaaaatcctaacgaggggttgatgagtccagaacatatgtatcgtctggtattcgagcacatgtctggagatacgtacctctctccgcatgccacaatgagacgcgcaggctcattgtccccttgttcttttgcttccatgtcaccattttaaaaatcgagcccacgccttcttgcaaggtctcgagacagaagaccttgcggcaaacatcatccagtttctatggacggaatcgagctgcatgaagcaacagcatgatatatttaattcaaacgagctggcatatcgtaaaaaaaaaggtttgtagaaaggaacgcgtcagaactttgtctacaagtttacacaccctagatgtagaacgctgtagcattgtatcatcatgttgttagcgttgcccttcttcaccagctgagcaaatatggggacacatggccgctgtacgttctaatgaacccaacttaaaaaatcaaaaaaaaatcaccgcatttcatcactctttcaatctgaagagcatgactttattccgataatattgaggactggtagagtgggtagactggggttgagggttctcagtctggaagcgatggacgcttcaccactcttgcttttagatgattctttgccctgatcgcactggtgccataacgggatctccgtgcacatgtccttttttcttaaaatgaaaaatctgaattcaccctgattcctgttactacggttgaatcgcccggcttccctccctcctaacagctattcttccattttttgccacgcttaaatctcattaccatggcagccttgattccggcctggctgggaatggacgtcaataaacccttcttgaactgacactgcgtgcttccctttctcgcttcttgggtccccacgcttaaaaaagttcctgcagctcaaaacagcaaaaaacaataaactatacccgtacttgcgctgaaagctggtgctcgaacggaccctgagggtggagcagaatcaacttgtcaagaccatttgtaaatagtgtatgagagatgcttcctgcccagtcttgtcaaaaaaaactcctgtctcttctcacatctttttttctttttttttccttctctcgcttttcggtctttcataatgtctattatacttgttcatgcccccgtttgttgaacttgaacttgactcctcttcggaacgcacggtagcccacgtatctgcacctataccattatacacccattgccgacatcgacgatttttttttctcaatatcgttgcagccctccaacgtgtgctttgcatagcgctttcttcctctttggtttctagaattacacaataccaagagaaccttgaacgtttcaacacaagtcatctcattgtaagcaccatatgcgtgatctactttaagccaaaaggaccaccctatgtcttcaggttctaacactttccggcagagactatttaatttttttttctagagcagccagttgacttttatttaattcctgaaaaccacctatggccaaaaatgcagccattccacctgccattggcgggcagggcaccatgagaaagaagagcaagaagatgaggctgcttcggaaccccttctccgatacagactccctgggcgcctcttccacctcctccccttcatcgttccggaacccgttctgtgacagctttgcactcatccacacctatggcgacgtgcgctcgtccgagaccgacggcgaggaggatggagaggaagaagatgaggcgagggtcatgcatgccaggagacaggcgctggtggccctggatcccacgaacaaggactcgtggaaggcagagttcaagtccctgaaagaatactcactcaaaaagatgagcctcgaacagcagcggcggcaggaattcgaatcgcaacagaagcaacagcagtctcgaaagtggatgatgatagagtcagctcatgagccccttgaggtcctggacgaacctcagtcagatcaagaccacgaggaaaaagaggaccaggtcgttcctgaggcaatcccctcggtatcgctgaagcgtccacaggagagcagtgacccctatgacccgcataaccgccacagtcgacagagcctgttttcgacccccaggacccccaagagacctgatgcggacgtgcctgaaatttcaatatcgttggctacacctccctcctctacacgcagtaatccacatgaaccctcttgctctgttgttgcagatcccgctctactctcgacgacatataccccttcaccactgtcgtcatctgccttggacccgctggacgcatcctggcagcagaaccttacccccgagaaggccaaggccaaggagcgacgtaccaccgtcgtgtacaagtccttgctccagcgcgtttctccctctacgcccgctatcgttcgccccattctaataggcgctggtggtactgttgaagacagtaatgtgcatccccttggagctccgttcgaaggagaaggtaccattgcgccaaaaccattgacgccatcgtcttggtcgttgaacagaaacacctttggcgcattttcgaaactagacccaaggcattctgtgcgcgatgagcaggactcacaactaatgccacagcccaccgccaaggcgaaatccaaacggaagtctcgactctttcggaagcagaggtcaaaccgacacgcgctcgatccatgggactcgtccgatgacatgttgatccaagtgaccgatgacgaagatggcactgatagggagaccccgttttcgggcgacagagagtcctttctcaaaggaaggatgggtgtgagaagggcgagtattggtgctcggacagaaaccgaccagggtggacctgtctctcggtcgatggaaaaagggccggtgggcgtcgttgaggactggattgtgcacccacgtacggctgccatcagaggaacgttccatcgggttcacgaggaagtcccagtgcccagcaaagactcgagaccctcgtcgctgggtcccgagttcctgactatttccttagcatcacccccaaggcatacgcccaagcaccagacgtttgtggacggtggtgcctcattggcgagagcacagtcgacagactcaccgcttactccgttgcgcaagggcgcatcggcgttcttcaagggattcgggaatgcctcgctacaagcacaaggctctagcagtcaagctgctttagacaaggatacggcagagagtacccaaataaggtgcatgatgaacggccaagcaccgccactcgctgatggaccttcgcctcagtcgcggcagtcggagatccctcacccgcggtccagcatgatgacctttgggtcccgcatgtcgaccaactctcctccacggattaccatggcctcctcgtttgcctcgttccgggacctgatctcctctgccactggactcgtccgctcctcgtccccagtctctgaaactgccactgccacggcgatgtttgcaccgttctcacctgctaccaacctctcaagggctcagtcgaccgcctatggtagcggtggagtacgacacagcgtcagtggtgtgcattcctcgagcactggtggcatttcgttctcaccaggttcaaggcgcaaaactgcattggtcatgatggcccccacaatcctcgttgctcagaaggcgttgtccatgtcaaaggacgagaagaagaacaaggacgatcctgatgcatcctctatgcacaccatctcgagttctctcaactcatcggcttcctcgtctctcaccacgctcgcctccggtcttgatcaacaacaggacgataaagacagatcagatagagaacagccagtcgccgaccctgacacccatggcaaatacctcaacaccgacacaccagagtccatgggtcatatggtgcccattacagagttgacgcctccaagacacactcttgctgagcagcgcctaccaacgacgacgatgaaggctagacatcacagtctgctcaaggtgcccgaacccgccaaaaccggatcgtcgtctcacaaccatcatcatcaccctcgtcagcaacagcagcatagtccacccagctccgttgctgcctcggccatggccgccgctcaacgagcctggctctccagtctgggtctgactcgaggcgaacgagagctgattcggtccacttcaactcgttccatgatcctgacctcgtccacagattccctcgcgggtcccttgacgggcgacgattatattggccagtttgaacgtgagcgcgcaaaagcgcgtggcatgttgatgacgacaacgggtactcgttcttttgcatccaaagcagggacagagtgctcctcctcgtcgtcagccacactaaccacgaccgccgaaacacccgcctccgaccatgagggccacccagagacctcaagaggcgagctaaggatgaagaatggcgttgttgcagcagacgagacccggaaccgacctccccatccaccacccatccgtcgcagccataccagtccgaataccaacaagaaaaaacacagcagtagcagtagcggtcgtgccaatggcttccgacgcagctttctgcagacgattcggatacgacccgagtcctcaggacccttggacatgtctgataaactgatgcatctcccagaaccctcccggttcgagggcatgtgctcctgtcgcggtgtgatcaatatcgcgagtatgctattgatcctcctgggccttgtgctgcttatcttgggatatccgatcgcgtcgagtttgaacaaggatcgcgtggctgcggaggaggcgacgggcatctctgcgacggcgccagcgattgctccagggtccgatgttctggtcgctgccgcaggctccgttccgccaggacataattccgtcgtagcagagaagagatccatcctcttgacggacacgaaagatgcgccgatgacgatggtgatgatgatgatggacaagagaaacgggtttgcgagggaaggtcggtcgttgaacgttgtgttccctcatgagttccatcgaaagcgcaagctggcttgaggacaaccaaaatcgaaagacgaaaaaaaaaattaaagtattcaacatcgcaccgcactcatgaccccttgtttttaattgtttgcttgctggagacgggagttgctgtaaaccatggcccatactttacgaaacgtacagcagtcctcaacatcgcctagccaacatgtgctgcttcagagtcgccttgactctgatattatatatttggctttgtaaaacttctctatctctgtggcttctcgcaagaactcggtttgctaagagcgccgcgttgttccaagagtttcctattcatgctgctcaaaccctgtgagttcaagattttggcacctgataccacaagctggtcatgccaggagctccagattagatgcacagacacggattgacaggtttcttgcaccttccacatgcagacggatgcatcggcgcaaccggttgacaagtagctgccgtctgtacttgcattccatgcgattgacacgacttctgcatgaaaatcattcacagcagctaaacaaagttcttctgcaacatcccagagccgcaccgttttatcgtcactgcccgaggcaatctgctggccgtcaggcgagaacaccacgctgtaaacaggtccggtgtggtcgcggaagatggcaccaggtgcaccggtttgagcgtcccagagccgcaccgtgttgtcgtcactacccgaggcaatctgctgaccgttgggcgagaacaccacgctgtaaacacagctagtgtggccactgaagatggcaccaggagcaccggtttgagcgtcccagagccgcaccgtcttgtcgaaactgcccgaagcaatctgctggccgttgggcgagaacaccacgctgtaaacacagctagtgtggccactgaagatggcaccaggtgcaccggtttgtgcgtcccagagccgcaccgtcttgtcggaactgcccgaggcgatctgctggccgttgggcgagaacaccacgctgttaacccgttcggtgaggccgctgaagatggcaccaggtgcaccggtttgtgcgtcccagagccgcaccgtatcgtcgccactgcccgaggcaatctgctgaccgtttggcgaaaacaccacgcttgtcacacaatcggtgtggccgctgaggatggcaccaggtgcaccggtttttgcgttccagagccgcacagtgttatcgctactgctcgaggcaatctgctgaccgcttggcgaaaacaccacgcgggaaaccaagtcggtgtggccgctgaggatggcaccggctgcatcgatttgtacatcccagagccgcaccgtcctgtcctcgctgcctgaggcaatctgctggccgttaggcgagaacaccacgctgacaacatatctagtgtggccactgaagatggcaccaggtgcaccggtttgtgcgtcccagagccgcaccgtcttgtcggaactgcccgaggcgatctgctggccgttgggcgagaacaccacgctgttaacccgttcggtgtggccgctgaagatggcaccaggtgcaccggtttgtgcgtcccagagccgcaccgtgttgtcgaaactgcccgaagcaaccttctggctgttgggcgagagcaccacactgaaaaccgagttggcgtggccgctgagaatgtcgcgaagtgcaccgctttgtgcgtcccagagccgcagcttcctgtcggaactgcctgaggcaatttgctggccgttgggcgagagcactacactgcaaacaggtccggtgtggccgctaaggatggcaccaggtgcaccggctgttgcgttccagagccgcacagtgttatcgccactgctcgaggcaatctgctgaccgtttggcgaaaacaccacgccgcaaaccatcttggtgtggccgctgagtatgcatatcctctcccacgttgatgtgttatgcaggctgattgtgccatagccgaggcccgcagcgaacgttttcccgtccggagagtacgtgcacgagcttacgctgccgtccgcgttgagatacgggtattcgccaaatcggacgccctccatttgcgcgtcattcagatcagcctggcgcagccaagtattgcgtaggttggtgtttctcagatctgcccctcgaaattgagctgaatcaaactgtccaccgcttaggtctgcgcctgcaattttgatagctgaaagatcggcgccattgaatgatacaccagcccgaaccaagacagtgatggcattagctgaggcttggcaagccagattgtctgttttagaccgctcgatgatctggtgaagttgctgttggaaatcgcgattatgctgggcgtgctcggcgagaaactggatgatcgacggctcctcgacaaggtcgttttggcttagagggtgcttggtgagacccccagaaacatcaagcaacacctctgtagcctcgcctgtctcgtagatatgtcgagagtaaaagtactccaacaacgagcgatgtaggaaccggtattgaacacctgaacgcgatagtgggctgcattctctcaggatcgtagtaagcggctgcgttccaaagaactgtgccttccacgtccccttgtcactcagcggcgagtactggacaactggatttccgtcctgttgtatgaagacagcggcggcaaggtctttcacgaatttgatcactgtgtcagcaaacccttcctcaagcagatcttgtagtgcattcttttcctctgccgcgaaattgatagtcctcagcctacgcttgctggtatccagccactgatcaatgaatgagttgtagagagtcagtcgagtcactttgatcttggtgatgtccgctccgtccttgaccacgccaggcagcgcacttagggccaaagagaggagaaagggattcttgaccagttccatcaagttggggatcgaccgcagcttctccatatagtcctcagcgctccagacggcactatcacccatcagtttgtgtacctctggatctcgcacaaactgatcaatgtagctcttaatctggtctcttgagaagggaacaatgacggcctcggtatacatgttccccgcagtggcaatgtatcgatcacgctcttgaggctggaataggtcgcggtaatcccgtccaagataggtgctcctgcagctgatgaccattttgatgtctgcttgtccctcttggttgaacatgttctcggagtgcaggttgaccttgagttgggtttcgtcgtagccatcgcaaatcaggatcatctttcgattctccttcagctctttgatcttgccctccgggaatttgtagatgcgcaactgcgcatctatgatatcgtcgtgtctattggccaccgcaggcaggttgatgaagagcggtatggggccacccggcttgtacgcagtccaaagctcgtgctcaaggtatctgttgaatgtcgatttgcctgctcctgaatcacccagcaccaagaagacttgtccgtcgctcttcaagaactcctcgaccttctgcatgagcgctacagccttctcgtcagaatcctgaagggtggccttggcttgaggagggatgtacacggtttatttgtactcattcagtcgtcgagaccggagtttgtcgacatcgtactcgacatagggtatttcctggactatggctagaagcggcgatgtctctggggtggagagataagatctcaaagggtagggatgtacgacagcggtagagccatcgcttgttgcggcctgcagaaaggtaagagccacttccctgattgttggatcaggcacctccgagatcttgtggaggatagtcagcatccaggacttgacgctctcgtcctgaccccactcagcgacatacaggtagagatctctcagaaaagtgacagcctgctcgcggagaccgagcacccattcctgatccatcgcaatctcgcccaggagctggctgactccccactggaatcttgagtcacgacggcaaggcacctcctgcaccagtttgctaaagtccttgagctgacctgctcggcagagtgctgtagcggtaagaacagcagggtaccacgggtgcttgtggccagagacaaggcccgttctcaggctgtcaaagagtccacgcccactgtcaatcaacgagctgacgccttcgtaagtggacttggcgatcccatacgtctcttcgaccgtcttttgcatctgcttgagcccttcaaacagtccgtcaaagttcaattgaatgacccccgagaccttaacaacgctctctgccgcgcctagagcgtatcgcaagacggcttgaaggttagattcgtcgtctggtacatactgcaacgcctgaaatgcgtacagggcttgatacatcagatatggatccgagctgccttgcagtccagagagaaccttggccaatggctctcgtctttcaacgcgagatagatccttgacttggtacgctggttcacccatgacatcaagaaggcgtgcgatggccaaggtcaaatggtacagatgctccgacgactgctgatgggtttcgagtagacgcactctgaggatgcccaagatctttacaaggtcatcggcgcccagaaaggtcggtggggagcactggaccagctgcacaagaccctggagcagatcaacatccagaagtacggacttgttgagctcctcaatgaagcaattgagcagcttgcggtagtgcgcctgatccaggacagagccaaggaggacgacttcagcgacagcgatcgggtccttaacagcatgcttgatgaattcctcgacaatgcgagatcccaaccagcggaggtgatcttgtttgatcgggtttccttcaatagctttgatccattcctgctctgcaccatcgggagacgcggcccatgaagccttgtttgtgagatcgaaagctgccccgaggcctttgctttgcaaagacgaagccgtgttcttccggagaagagtgatgcacaaggcgagctgagatgtacggtcaatgcgtgcgtcgagacatggcagtgtgattccagtggtagttctgctcacgttctccgagaagacatggacgcgaacctcacttgtacagctcgtgagctgtgatgcagtctcagagctaccgactttgaggctggagacaatggaggcagtgtcggtgctagaggcgcgaccgtggtggatctttgtctttgaatgatcatcctccaccttggccttatcctcatgctttgttgaccgaaatatattcagtaatttgtctcgttttctgggtttctgagacgagatggaccgattgtcgccgtcggaactcaagctggctcgctgagacgaaagcgctgttgagccctggctgacagatcgaccgtgggcggcaagcgatggggccaatgatccgctggcagatcccccgatgccaggtggcgaggtgttgggtggattgctcatagttgccgtgcctggatgatgtatccgagaacgcaaatgtataccgttagcgtatgctttgagcgaaggcaacaaggcgctgagcggagctatgcgttgctcttaccgttagtaagctgggagctatcacgctgatgacgaggaagcggacaatgaaggactcaatgaaattcagggacggtggctctaaggtgtgcatcgagtattcacacgagatcgtattagcgactgtatcagtacccatggctggatcaaacgatatatgttcgtgggccttgcagtacctagagagtggtaaacgagagagcgttccccaagagcgttgtgagatctgtcagtctgagatggctcaggggtgatgtcattcaagacgaccggtcgattgagggtctgaaggtcaaaggaatgatgtgcctcggcgatgatatgagtgcaccactggagataacaggtgatgggatggtgaggtgggaaggaacaaggtacgaaaaaccaaaaaaaaattgcgtgggagcgacacaaaatctcaatcttcgccttcaccttcgatccatcttgtgtaccgtggagcattgcgttccttagcatggatatgcaggggcaccttgtaacagcactggcatctgctcgctcttgtagtttacaaatcgcatcaactgcgcgctaaattcaagttgacagcgcgataagttctctggaattaggtgagagccacagagtcgtatctccacgtgtggctagcagttcctcgctctgcagatcacgtaacgtaaacagtacaggtacccctgtctcgatgagcatcctgcgtgaattgcacgcgatctgaaaccgtcgtgatctgcggatagggtgaattcacagatacaacaccaacaattcaacgaactggacagaaatgcagccatgttcttgaagtcaagcatccttgcaactgcaccatcttttttttttgtgaaatcggtatcaaaggtatgaagtattttgtttttttctatttttttgtttcgtttacactattcctgttttacagttgctgagaaactgtcgatgcagagtttgcgggagggggcgttcctgtgaaataatgattctggtatttgttttttggtggctccgagccgttcggaggatgactggtcgctgctgcttcactgacagatgtcgtcgttgttgttgtcgaggacgcctcgtctccagtcgcaaaagcggccgctcccagagcaaacttcgagttctgggacgatgctgctgcagccggcgccgggtagatgaatccagccagctggatctcgggtgacgacaaaatccgcgacgtccttggggaaggcgtcacctccaaattcgtgctctcgtcgctcggtgtccattcgccagccccaaacgacgcaaacggcgatgtagtcgtcgcaggatgggcctttcccacagagtgggtccttgtcaccgtggcaccggctcctgaagcgcccgcccctgtggttgtcgtcgttggcgtgcttgaactcgtgggagaagctgaagaggaaggagacaccagacctcctgaaacggaccccgatcgaccttgctcaccaaacaacatggaatgcctctttttccgtcctggcacctcccattccgatggcagtcctgtgaacgagtcctgccggctgtggccatggggtccaggccgtgaagaaccttgattaggcgacgatggcaatgaggaagcagctgaggatgttgtgttcacgccgtggatcgagtcccgattactgcttttgagaactttgaaggggttaaggtcctcaaacacttgatcaatcttggaactccctgtcgaccagcgtacagagtgacccttcaccatctgtgattgcgagtgccctcccatatcggcgctgctgtggaagggtccaagctcgtcatcgtcttcgccttgcaggtgccttggtttcggtggcatcgcagagttggtgaaatgtgccctgaattggcttggggacatcagaccagcggcagcagcggtggtcgttggtgagaacctagcagaatcccgctttgtcctcgctactgaggaagtgtcgatccttgggtgctgctgctgctgttgctgacggctgctctgcttgatagaatcgacactggctcgcttctcatgcatcgtcaatgtgttgaaagatgactggagcatgctctgccgcctattctcctgttcctgtcgggccacgtctcgctttccgtttttctgtgtcggtctctcgtctccagagttctccaggtcctctgtagtgtccaccaagacatgggtcggcgcctcttcatcgaacagcaccgatctgcggtgccctcccgtggcgactgcgacagctcctgctgatatgctcgcaatcccagctcctatgaacccttcgttgatcgaccggctgtccttgggtgtcctgaagggatccgactgaaagctagacttgctggtgaaacttatccgacgccctcttgtggacgatccaccgtttctgctgtcgccacccacagttgaggacaccatgctggacacgtcgtccgcatccatcattcctctgcggctgctgaagagcgatgggacgtcgctttcctcatccagaccttgcccatggcgactttggcgtttgctggatcgcttctttttcaacgacagcttggactttttggctgacggatccttggagccgctaccacccttggccgacttgctcctctgctccatctcgtgtgcgtcctcgtcctcatcatcctcgtacatgttgtccagtgatgacagttgtccgcctgcgggggactgttcaggcttgggcgcactcagcattttgacgccatagatcagcgccccgattccgatgagaacgagaagcagcacccagggctcataatcgccgagctggttgaggtagatggtcgagttgatcagtccgaatgcggtgtagaacccgtaaaatgtcggcaccaccagcacagagtcgtacaactttagtcccgtgttgaggcagtaaacctaaatgcgtccggagagtaaaaaaaaaacagagtgcgcggtatttttagtgcatggctgcatgcatcgtacgtcccgtatgtcccgtatgggttcctcggtccattgtcgttttcccatattcttgcgatatttacctggagaatcgctgtaaagaccaggacaaagaggatgaaataactcaggtagtcgccaaactggttctgtcccgccactgtggaggtgattaacttgataccgctcttggccagaagcaatgtctcgctcgccaaaagtcctccgcatgcggacatgatcatggccacaacctttttcaggcgttggtcccgcgcctcagcctccagaccttcatcgccctccaatgtcaatcccgaggcccttgcgaaacggttggtgccaaggagataggttagcttggtcttcatgtttttccgcagctgtccagattcgtcgtcgagcgagatggcccaatacgcgtacatgccgagggcgaggaacatgaagatgatggtgttgaggatcgaaaagtagatgataaagaccacccgcgcaaagagttgcttcaggtcgtcgagcgtgagtttgtcctcgagatcgccgcttgagttcatgccgccaaagaccacgacccagacgacggaggccatgacaacgatggtcccgtagacgtcctgacgcgtgatctgagtcccaaccaggatcttggcgaacacaaagttgaagatcagtgcgatcgagccgagtggtgcgacccattgtgtcttgagaaagtctatcgagcaggagtgaaatgagcaaaggttagtccatgctgtgctggaatgactgtaaggtttatgctgcctgacactttatccgtgtccttgcgcccttgtccttccttgtccttccttgtcctgtcccagtcccttgtcccagtcctggtcggaggcgtattctcctttctccaggtctcgtctcactctgagctcggcgcatccatgtctcatgccccaccggctgtctctatctcaggattcatcatccctttaattttttttctttttcccctttggagccgccaggcggatctctgcatcagtcgggaatatggcccctatccgatattgtatggctgtgtcgaaacgaaacgaggagggaagactacgcactcaagtatatgacactatcgacacgaaaatacgagagccacacacttactcaaggcaatcgtgctccctgccagctggcttgctatgtacaggtacagtccaacgtgccacatgggccgaccgcattcgttgcgctgcctctcactcgaaagcgcgctgttccggacatggtccagtttgagcaggttcaggcctgcggcgttcatgaccgatgcgatcagcgagaccgtaaagccgatcacaaagtccaagaaggcgctccctgttactgccatcggatgtcgtgcgcgccgtgagacgtggtgtggatttgaaagagtaggtcgggaaacagaacggtcgtgtggagagaagacgaacagtgagaaacaagcacaccactcacggagcagcagaaagagggaacagggcggggaaaaggaggtgatgcggttgtgatgtgcagcgttgttggttctgtcctgatgtccctggtgttcctttggtgctcctttggtgtccagatgggctgatgggttgatgggctgatggcgtgaggagaggagagagagggagggtgagagagagcggtgtctgagggttatggttgttccgtgatgggaaggcgggtgggcaacggctagagttggagggtggggcaaggtgcggtgcaaaggaacacctgtccctgcggtgagtgtgaatggggaacgcagacaggctgcaggcaggagagacagagagacagaaagagggaacgagagagagacggagacaagaacagaaaagacgtaaacgacaagtgtggacagacacacggtgggagtgggatccttgcagatgcgtgctggcgatgcagacgcaggagggatgatgatgaagagtgtgcaggcagacgggatgggatgaggagcagccaaaacaagaggactgaacgaagcaaagcagagacaacaaagaggatgtgctgaacacatcagaaatagacaggccatgggagggcaggggacatccagcaagtgtgctcactcaccctgccaaggacagtcgtgtgtgcacgccccaatggtgcaggcctctttcgccttgactttgctctctcgtccatcgcacctcttgctctcactcaccatcatcctcactctcactctcttcgctctgttcactctctttaccctctatcgcgtactcttgtcatcatgcatcactggaatgggcctaatatgatatatcaaaggagagaatcgatgatcgtcctcctcctccttctccgtccagttcccatgtcccatcgacctaaaaatatatatcatctcaacgacccaacgctcccctcaactcttgggtccctgtgccctatgcccgaattaatatcataatttcggcggaaagttgagagcatcaacagacatgggtggcacaaaaacacacgggacactacaaaccaaacaaaaaaaacgaagagcacccattcccccttcctccaatccacgctgcaacgccgtcttgtcagcattgggcatcccacgttgttgctgcaatcatgatccgctctgaccgttctgaaggatacagcgccctcagctcacatctcgtctcaccatgtgcatcaaatatactcataagatctgtagcatgtgcaatactttggcaagtaaccacttggacatccatcatcgcggaatggtctatgggcagcagcaatagggcttgttaacgttggattcctatcaaaggtatcttgtgctgtacacgtacatatcacagtcaagacttctcaattggacagagcgcttacgtcgatgaaaataattcattattttttttatctctctctctccctctctttgtttgtctagttctgtcatggtgcatgctcccaaatgattctctccatgatcctgcatggccatgaccgtcacagggaattgagagctgttgtcacgtaccgcgtcgtcggagcactctctgaagccaggcacaggtccacttgtttcagtagcctcttattggtccgttcacaaatgccgcgagagaaaaaaaaaaaagtttgaaatgacgcgcctaaaaggactacccgtagcatgagcgctgttccaacatgacagggggatgggggttcaagggacctttatttttcaggtgaatatacatttgaaaggcgtatgtacatgtacttcagagcgacctatgtatatacacgggagaggcatggcctattggcctaagcaactttgagcgtgcatcacacggcagaagaggagaggatagaaataaaaatacaaatgtgccccatggatcctcgctccctcagaattcgcagtcgtgctcatggccgtcgcagtccagagagatgttcctcagatgagaccaatggctcttcatccagtcttgctccgctggaccaacattgtgcgcaaagtgcttgacctggaaggcctcaagttgcgtcaaagttccgagtcgctccagtccgccgttcgccaaggtgaaatccgtaaagctctggacatcacgaacgccattgcgaaggtgcagcaccctcaggttgtgaagcgtgccgagtcggttcaggaatgtatctctagtggatcctgcacacttgcccggttgaatcgaaatcttgaggacccgcagagactcggagcacacccaaggcaccgctttgccccttgccatagctggcctgaagtagtagcccctccttgcattggcgtaatcgtgcagcgagaccagctcctgtagtcgaggcgctcttaaaaagagagcaaggagatcagacgcgtcaaggccacggtgcggcaagatcactttctccaacgtcgctgcatgtttgacaatcgctgcgctggagaccactccaaagttgggcgcatcaaccttgatagatcgccagttgaagcctcgagatgcatcctgcttttgctgcggcagctgctcctgctcctgctcggtatttcttgacgtatatgaagatgcggcgaacgatgctcttgtcaccctaacgtttgttgtggtctcagtgtcggtagccgtagtatcggtagtcgtagtatcggtccaaataagacttgcgatttgctggtcttgaagatcaagctcgtcgcatttaatctcgagttcatccagcagcgggcaggactttttcaacattgagttgatatgctcagggtccatgtgcgatagaccacccagcaatgcgagcgaccgtaagccctgaagccgatccagaaggcgagataccacaggctcaggggtggaaaggatgctggcatgaagtccgagccttttgatggcgacagggctgttcttgcgtgggatgtacgggcacacgggcagttggtcgtcgcctggacaaatggacatgtttaacgtcaagtcggatacctgtcctgggagtgcatccagcaacagtgccactgttttcgagtaggtcggagtcttgttgtaaccgctgatgctcagggtctgcagatgttggagagcactgatggatgcccccagcagcgggtggtgtagcagcgtgaggtcgacctctactgacgtgaggagcgggcttgaggagagaatgcagagaacagcggtgtcccactgcagagtgcatggggttccgaggacaaggccgtcctcgatggatgggggttcgtcactgccccaccatcgcaagcttatacggcgcagttctgtcttcatgagaacgagtggacccgttggcgtgttggagggggtgggcaggagtgcggtgatgagtgcagagagtgcgtgatgtgagcctgtggtgaaggactggatgtgatgccggtgggtcctcagggcgcccgccgcatctgggctggtgatgaagacctcgcctgccttgtccatgatgaagatgtcggtccagaagcacgggttactgaagaacatgcagactgccgcagcaaagtccttgtccatggcctcgaggagtgggctgaagggagatgcagggtgcgatttcaggtcagtggtcagtgcatcgacgtgtgtgcaggacgaggaggagctcgagccagcatccatcctaccgacgtgctcgctggaggacacgtccatgccacactccatcgctcgcgagtcttgcttgggatagaagaagaagtgtctgctgtgtgccgtggggtctgctgtgttgtgtggtatggtctgctgtattgtgtggtatggtctgctgtattgtgtcgtatggtctgctgtgtcgtatcagcagctgtgcaaaaggcaaacgagaggaacagaaaaaagcacagaaaaaaaaaagagaacgaacgagccgtttggtggcgaagcacaggaggggcatgcacctatatcgtagacgccggtcacaaaaagtcaaaaactggcccccaaatgcgcggcccgcttctatggaaactttaaacggctgaacgagaaattcaacgccagaggggaaaaaaagacaacacctccatcccatctcatgctccctgtcaatgttccatcagtctcgccagttctgcattgactgtcatcctatgctcataggccgtggcaagcctgttacgttcttcattatgatcgtctcctcagcgtgcagcttgcgaaatcgcatcgccgtacacgcgtagcgcctgctatagattgtgtcggtcatgtccttcaagagcaaagccatctctctgccgtcgtggaggactttggtgcctgtagcgcctctgttctttacctcatgagcccctccctcataaggggttttcttgcaaaagatctagcggtcagtttttcgatattgtgcgcgccttgttttgaagactcgctcgctgttgaatgtggaccgtaccaggctattaatcaaatcgtccacttccggctgccgtaagatccaggaatatgccccatcgtataccacggctctgaatgggtgactagcaggagcagtccaagcttcttgtgcaagctgacgagctgcagtatgataaacctgagccgctttgtgatgtgttgaacgtggccttctcttctttttgtacaacctcttccccatgggtttgatgtgcaaacggtcgacgtttgctttcgtgtctttgtccgtctcttagtgacagctatctccaattgcgtctattgatgactttcaaaccagggtgtccgtttgctcaggtttttggtatgtgttacaacggatgttgctcctattcaaaactatagcgccaaaaaaaaatagagcagtggaattcagctatttgtgcaagatgaacatttcacattcacgcacttactaatggagccggcgccgttgcattgaaggaagccatatgtcctatgaactgtactgagggaggttggactacgtgtacggactacgtagaaggggacgcgactagaaaatagccgaggcataggcaaaggttaacttatttggtccttgcttgaccactgatcacaccctgaaggtgaggtgggagattgttacgggcactgttgtcgtgaaatacaggcgacgagaaaggggtaaggaaagcggttttcgctttttcgagggtagtcagaacactgtacgtgaaggctgaatgatgccaccagtttaaagtcggggtctgaccgagacaaaggtgtgcctactgaggggggaagtgtgagaaaaagtgccagtgcgcgaccacacataggtcaaccagcacatgaacaagggggtatgcatggctactgcgacaagaacgaaaaaaaaaaagccatggtcgagggggaatgaacaagatgacattcattcaattgactccatccttccctgccattctgccacacccctgcaaactcagcctgacaccccctaccgagccgaatattctccaaagcgccgttcaaagttacaatgtcggaagtctctgatatcagcacccgacgacttcagaacgtcaagcaatcaaagctactccagtgcccctacgagctgctaaggctcatcatcgcctattttagaacgattgtcgagctcaagcacttcacccacacctgctcaatgctgtttcacatagtcgacgccaaggactggtccacactgtactacttacagcacccgacgagaatacctcccttgcgcttcgaccatcatgaacctcacgatacggattactggaagtgcacgtccttgaacagacgtggttataatcgcagccttaatggtacatttctacgtgatataacagatcctcctagtccagttcatgaagcgggcgatctgttccaggggcagctttgttggctgctgcaactttgtggctagcacaacatgaattataggtgtgagtgataacaatcattccatttgaacgttgctttagttgtggtgactggacatataggcgtcggcagatccaaccttgtctcacgatttgtgagaaacaaagtctgccccaagcgcagggcagccctggaagtcgactttggcatcagcaatgtctggatccgttcagaaattatcaacgtttcgatttggggtatggcttaaggatgtgtgtttactggttcactgacgagggggggggggggggtttaacccttcagcatcaatggtcttcacagcctgcatgccgatcaattgggtgtgttcactaacatcgccttcatgtaatacttcaatgccatttgcttttttttcgtctagcttcaaattacccccatcgatcaaacactccctcgcgctataggcgcgttcacggcgttgtaatggtctatgatattacccgtcgtttcacgtatgaggacttacatcaccggcttagggagatcgacttccacgtcaaatccaacatcccgatcatgcttgtgggaaacaagagtgatctaagtcacctgcgtactgtctccacggacgagggtatgcacttcgcagccgagaacggtctatcgttcatcgaggtctcagccttggacttgagcaatgtccagcttttgttccagcgctttctgacaggtaaaaggaaaagaatgcagcaacaaactgtaactccaacgcgagaagaaaacttgacgacacgatgcatactcagatgtgatatactgtggtttacgtcgcctgcatagaagtttacatggccaacacctttccttacaagtgttgagaggggtttgagaatgcattcgctcaccagaagatggaaccatctattcgagcttgcacaaaagaatgccaactcgcctagaaaatgctgttaaatgggaggtgccatcaaggcaatcgggaaggcgagcctgcactgaagaataaaaaacgagctgatcatcacagaagaatctcgctggccgcataaaaatgcccatcgggcaagtccttccagtagcatgtgccatccccacgagcttgatctcgaagtgcaaggagctgaactcctcgtgggcacaggccgccccagtcttccaagcactggatgtcactgatggctacacaaaagacgacctccaggctgctcacacagagctgcgggctgcaaacacagcctacccagatcagcaaaaaagccagacgccgggcaggatctggccacgcgcttgagaacaacgtcccacctcgagcacttctacgactctccaagtgcgccaagatgccccgcatctggaccttgctctactggttcaaccgcatgccgccctacggagtgaaatgcgcggcgtgcggcgaatgcatgacgatcagtcgtcgcaacatccaggacgactgcctcctctggcaacaatatgctgcctcagactggtacaaagagtccatcaaccaaagcgcgcagttctggttggacagatgcttcctgtctgcaaagacccttacgatgacgaacgccttcttctggtccgcggccacgtacatatggcgcttccgagatcattgcctcaacttgaccgatccggacatagatgccagttgacccgcgcctcctggtcctcatgggcccccctagcacccccttcaccctcgaagggtacaccgatccgccttcacaggcacttagtttagcttacatatggccccctgattcaactgcccctccatagcaccatagttaggaactgaaccaccaacattagcgggttcctttgaatagtatcataaagtgttaagaatcacagaagaagtctatttactatggtctgaacactgctttctactacggctgctaacaaggctttttagccttgctattcacgactccgcttgggtgagtttttgggtgtcgtgagagtggggacgtgggccggcggtggggtacaagcacgagacttcccgctcagcttaagcaaaaggtcctcggcttctgggtgcattgaaattgtatgtacaagtaagctcggccataggctccatgcggtctctcaaaagcagtatttcgttgatcaatacgagcacagttcgtatactatgctggtcccaggttaaaaggacctttatagcgcgcccgcgctgcagttggcacgacctcccgtcgaggtgtcgcagggatgcgaactgagcgtgtagtccgtagtttagcaagccgtgcgtccggtcttgcagaagactaagctatagatctctctatcctgatgagactataacgcacactttacaaagctcgtactgtactgttcatgcttatcatataggctagacagccgcagcatcactaggtcttcaacatcatccacagagcgtgcctatcgcgtacttgcgacgcctcttattccatgtgttggatttcataccgttgactgcatctcttgactgtataggtctcctatatgactctcaagccagggttccttccaagttcgctttggccttccgtatatgttgtaactgacgtcgctctattataactatagcgccagaaaaagagtcagctatttgtgccagatgaacattgcaattcacattcacacacttacaaatggagtaggagccgtcgcattgaaggaagccctatgtcctatgaactacactgagggacgacgtgagtggggacgcgactggaacgagccgaggcagaggcaaatttatttataatagcactgctgactattgatcacactccgaaggtgtattaaatgggctgagtactgcttgctactacggctacttacagggttgcttggtagtacattctcggccccgcctgggcgtgggcctgtggtatgaactaccaccacatgcactgcgtacctcgacctcttttcactttaggatcaggtcgaagaagcagctcctcttgctttctcttctgaagattcgccattttgactgccttgacggcatccctactgagtttcggagcatatttggcagcctctcgtaaaactttggggtggccggatgctaagtcccgatgtgaagtcactcatccaggaggcctattctgccatgatcttttcctgttgctttgcgacagccgttgcggaagctggcatactcctgtggacagcaccacagttcctatgattgcgccaagaagtatcccgcgcctttccgcttcggattgatgtgcaccttccagctgtcgtccatgtgtaaagagttggatcatcggagacagtgatcagaaaagaacgcctttgtcacgtatttgtgagcgacgagcgacacgtcaaccgagccacagacgaacaattgcgcatgcatttgcgagtgagaaatatctcacacctccctcccacactcctccacacacacacacaacacatacacccttctccgatgagcaaaaggtaatggtgatgttcagctgccgtctgttgacctgagaacgagcaaggccctgtcatacactctgggggcaactcagcaccacaggccaccgcgcccaatggtgtctgagcctggggtcaaggcatcggccgacgaccagtgcgaggaagcgattcctccactgtccatgtttgaaatcggtgctcgattctgtcccatccctcctttccttcctattgcagacctgcctttcagtcttgagggacactggctcaggttgaagttgcagttgtcaccgttcagtcgcgacgactcgcaacatgcacctgcgaaactgagtgttgtctggagaggcaaaatctcatgaaaaagagcgagcaaggcaccgttgtctggtccaggagctcccttcgcccatgctgcgatcaggcgtagtggtgtgggtgttggcctgaggtacgacacaacacgacgtgctgatgaccggtgtgcgccatgacacgcatagtttcgacaccgtccatgcttttgaagctggtgctcagttctatcttccagataacactccttttcgcttgacccccttatgttcgcagggctttgcagctttgagatttaaaaccttttcatgaatgagagcgagcaaggcaccgttgtctggcctgggaactcccttcgcccatgctgcgatcaggcgtagtagtgtgggtgttggcctggggtacgacacaacacgacgtgctgatgaccggtgagcgccatgacacgcatagtttcgacaccgtccatgcttttaaagctggtgctccgttctactcttagaccaccctgtcttttacataagccttgggacaaaaaattgtcagtagtgcgggctgtcgttaaccgttacatttttttttagtgcaatttgctttagtgacagcgatacctaaggagaagaggcccagcaatcattttttaataaaattgccgtattcatgtactcaagtaaagagggaggcaaaggccatcttattgttacagaaatccagtgctgcccacagcgcctagcagagcttgatcttgctctctcgactccgcttgggtgaatttttcggtgtcgtgagagtcgggacgtcggccggcggtggggtgcaagcacgagacttgccgctcagctctcgcaaaaggtcctcgtgtcctgggtgcagtaggttgtaagtgagctcggccatagcctccatgcggcctcttaaagcagcatctccttgaccaacacgagaacagaacgaacgctatgctcgtcccaaattaaagggattgtcagagtgcgcccgcgctctgccgtcgagatatcgcaaggatacaagttgagcgcgaagtcccgatatcagcaaaccgtatacccggagttcgcgtcggggccaaggcttgttggagatccttgtgcagatcgtatcagccatgtctttgaggagcttcgccatcttccggccatccttaagaaccttggtgcctgtggcacccccctcggccttgcccacctcaacgggccccaccccacattgggtctttttacaaatgatcacgccgtcaatctttcgcccatgcgcgtgcctgctctccaggtcacggtcgctattcctagggttgattccacctccagtgtcatcgtgtattcgtacaggatctggtcgacatcggctcccgaaggaagcagccatggcacccgcgcatactctttgaaagtagccgagtattcgctacgcattcgacgcaatgctccttggctaagactaccggtagaagatgaggccgtagatgaggatgaggacgtataagcggatgagtttgaggacggggctacttttggcgactccaaaggtgatgcagacggatttttttgctctgataaaagtgatgcagacgaactcagcggtgatgcgtgtatctcgtgattctcatcattcgaagagggcagtgggagtttatcgcgctttgacgaagagccgcgtgcacgggtggtccagatcctgaacatgcgcagagaggctgtcgaagtttgaaccgcaacatcattccatgctcgtaccttgctagacctgagtacttggagccagtccttctattccttatttggtgcgcggaatatttttttttaaccgttcttgaggcatcaggtttgtgctacccttgacatcccgcgccacaaagaatgaaaaaagagatgttgttctttcgaacaaatctttacaacaaatacttaatctcagcaaatcgacgcaacagagcgtctctactgcttacaataccgttgcttaaaagtcgtctgcaatggatttatctctttcaatatttgaaattaacattcgcaggggcatcgtaaaagtctttccactttacaacgccatccgacatgatatgacactggggctcgaggccctattcgtattcaactaaaaatcgaaaggcggtaatcgtcgcgttctagcacggattgtgacttagaggcgttcagccataatccaacggatgatagcttcgggccattgcttgctcaagcaggcccaaataccaattatccgatatgaacggttcctctcgtactaagttcaattactattgcaacaacatttcatcagtagggtaaaactaacctgtctcacgacggtctaacccagctcacgttccctatgagtgggtgaacaatccaacgcttactgaattctgcttcagtatgataggaagagcttgaaggatcaaaaagagtatactggaaaaaggaaggatgccgaaaagaccaagggcagaaaagatcgaaggcatgcagaggagacgagtgatgctaagagttgaaagggatgccgatgtgaggagggacaccaaaaacatgtagagagagagatggtatgctgctactgtagcaaaaaaataaaggggccacagagaacaaggggcaggagtaaggagagtggttaagttgaaagagagactggagatcaagctaggcaatctattcgtgtgcttttctttgctcgcaaggtcaactctttctttgcgtccccttgatatttatggcgtctcttctttttgttagatcgcccttgatcatttaggccttcttcagttttccactctgcacccccccccccccccccctcgatatttttaacatatcaaacttcttcgtagtattccttctcgatactgaaaatgattggacgggaaaagtgttgccttaagaagcatgattgttttggattaacagtttggtcgagagtataaggcgccatcttcgttcttcctgaaggaacgcacataccagtccctttcttgtttccagacacactgacagcagccaccacctaccttaactcgaacacctgcactttttttatatggcaagccgctttgccacttactcctgtctaatgctcacgcacacccttcctctacaacctgccattatagcatgaagaccaccgtcctttttctcctgagtcttactctttcgatgtcattcgcaaaagtgcaccccacggttcccctcaaaaaacgtcaatcttaccagactttctatcagacatgcaattccaatcttaatcagtgctacactgaccttgtgagtgcccagagccagctccagcagtgccagagccagctccagcagcgccagagccagctccagcagcgccagagccagctccagcagcgccaagccggggatcgagagaaggattgtttgaaatgcgttttattcactacgatcgatcaatgcgctcgcgcaacctctggcaattcttgggaaatttgtttcaagaacaaacgcgaccgcatgtacgctcggtgtgtggatgaccccagttatgcttgtggcgcagacgataattagagtcccccatcatctagacgccattatcactgttatcactgccgtggagtcaggtcgttagatcttatgcagaataaacgccgcccaaagcagcccgtatgagctttgaacggggtttcatatttcatgtatgagttacgaaggcttgcagttgttgggctcaagcgagcttgtacatcgcggtggcgttcgctccagcggcgaggcggacagcggcatagccttgggccgagagctggcatggttgttatagaccaaagagatagtccgctcccagtttgcgtcaatctactgctttcagaaggggatgctctttggccttcggtatatgttacaacagatgtagctctataaattgatgtcacacatcccttcgacaacacacgttttcaaacatggacagctggaaagaacacatcaatccgaagcggcaaggcgcgggatactttttggcgcaatcacaggaactgagatgatgtccacaggagtatgcctctttccgcaacggctctcgtaatcaacaggaaaagatcatggcagaatgggcgtcctggatgcgggactttgcatccagttactacaaagtcctttgagaggctgccgaacatgcttcgaagctcagcagagacaccatcaaggcagtcaggatggcgaaacttcagaagagaaagcaagaggaactgcttcttcgagctgatcctcaagcgaaaagcattcgcggtacgcactgcatgtggtagtagtcttcgtctagctcgttttataatatgcgttgttgtttactgacctagctgtcaagttttggttgaagcggcaacatcgatatcgctggagcccacctcagagtgcttgagatgatacggcagccggcttacatagtgagaaggtcggcaggaactcaatcaccagactggaagtcactcgcgtgaaggatcgcaaagcgtacatttaacaggacgagtccgatcatacgtcgaagttggtctgctgcttcgtgcgacaagacagctctacgacagcaccatgaaaggagctccatggaaggagtgggtcgcgatatggtgactctcgagcacacatcattgccagggcagctgtgatccagttaaagcttcgggtagcactagaacatgcccactcaagattggtgtaaggttaaaagtctcagccaccacagaatctggatcggcattcaaggtttgctcttatttcagggcgctgattcggcatctcctacattccttgtcaccgcttcaatcaacaaaatcagcatggatcccttcgccgtcttaccaccggagctgcacaggctgactgtccaacatctcgatcgcaagaccattgtcgcctgtgctcttgtgagtcgcagctggtccaggctgttcgttccgagcgtgtgggaatcggtcaccatcacaaccgatgtccagtttagagccttcagagcctcagtcaataacggcgccctatcacgccacggacacctcatccgcgcgctcaaagcagcaacctacggggtcgtcgtgatgctcgttgcgcgtggagttgccacttgcaccaacctaacgcaactcgatacagccttcaggggcgtcatcagagagcgtgccaacgagccgattgtcttcggacccctacccttggcgtgcctcttgaagaataatcctggattgaaatcggtcactctacatgcgcatcgcccaagaatgcagctgtcgctgtcgcaggttctttccgcccttcccgcgaacgtcgagtacttgaaacttgactccaacaccgcgtcgacatggagcgatgaagttgaatggtcgattgaggcctacaagaaggatcttgccagcgccatacgcgaaacagatcatcgtttcaagggcgacgtgccaacattgaagctgaggagattggagctgctgggaacaattcagagcgatgcttttgtgcttgagactttgaaacggtcaccgctactcgagtgtcttgctgtcgatccggcgatggactacatgtatagcgataaaacggaggggctgaagagtgttcttcgtgaccactgccctgctctcaccagcctatacatgaatcctggacgactggacgacgaatatatatcccatttggtggatgaggcgagtaccaagggttggaagcacctcactttcaaaggggagggattccgtcggctaacggaggcagctatcttgaagcatgctaattcgcttgagagcgtgcacttggacattgagcatggatttcctagcagcgtggtacagaagttgttttgctccgcgcccaacctgaagagctttcgcgtaggctggcaaccgttcgttcgaacggacgttcaactgaacgccaccgatatgatccagtcatcctgggtttgtcactcgctggagaaacttcatctttgcatatcaggcataccacggcctgatctgaccgcgaggacgaatggccggccattaaagggaccattgcacgagggcatgtccatggaatcaagctacacggtgcaacggcaagtgtatgcgcaactaggcaagttgacaaagctgagggagcttgtgctgtccctgccttttgggagtacgagagaacactatgaggagggtttttctggttccgagtacggtactgcgggcgggcaccatagcccgagcttatcacaggcagaacctcggtacgaatgcctatcattcacgctggagagcggcctcgatctactgggggacctgaaagagctgcgagtgatcgatctgaggcacttggtggtcggaatcgatggcgaggcagagcagcgatgggtgaaggagcattggcccttagtgaggcagatataggcaacttgcacacgatgtacctggaaaatgaatcatatgcttactgtgaaagtcgaaaagggaatcaaatcgatgatgtgcttttcaggagtctgaaaagggtcagtaggcgactatcaacgagtaccgtgaagcattgtagagtgataaaagacaacgacaatcttgtgcttgacgtcaaggtctgtcgcggtgtaaagtcagcgatgtgctcgtgagtgtgagtgtactggcattcattgccttgctcagacttgcacgatcgcttcagtgtgtcctctcacacgaaaagtttcactttgacacgctttgcatttaaggttcgccgtatttaagtcatcgcctggcaccaattgcgatccctgcgtcataaatcgctcttctcctcaatcacaatcagcatgaatccctttgccgtcctcccaccggagctgcacaagtcggttatccaacatctcgaccgcaagaccattgtcgcatgtgcacttgtgagtcgcagctggtacaaggagttctgccggagcgtgtggcaaacggtcaccatcacaacccctatccagtttgaagccttcagagcctcagtcgacagcggagccctctcacgccacggacacctcatcagcacgctcaagactgaaaactatggagttatcgagatgcttgtcgccaatggggccgctacttgcaccaacctcacgcaacttggtgtgacctacatgcgcttccgcaaagaatgctccaaggggtcaatttacaagatagccctaccgctggtgcacctcttgaaaaataacgctggcttgaaatctctcactctgcacggaagcatcctcactaggcggctgctattgtcgcagattcttttcgccctccccgcgagcgtggatcacttgagactcgatcacaacagcgaatggccacaggacgattataccgagctgatggctgaattccataagcaggaacttgccagtatcttaaggaaaagcgacgacggcagcagggggaatctgccaacattggggctgaggagaatggagctattgggaccggttcagggcgaggctattgtgcttgaaactctgaaacggtcaccgctgctcgagagttttgttttcgacgaggccttgctctgtttgtatatgggaggtgaggaggagctaccggatgttcttcgtaaccactgtcctgctctcaccagcctgtacatggatcctggatttgtggacgacggatttctgtcccagttggtggataaggcgagtaccaagggttggaagcaactcgctttctcaggggagggatttggcccgctgacggaggcagcaatcatgaagcatgttgcatcgctcgagagtttacacttgaacattggccttgggttccctagcagttcgatacagaagttgttttgctccgcgcccaacttgaagagctttcgcggaggcaggccgtcgttcgtatatgcagacgttcaactggacgccattgacatgatccagtcatcctgggtttgtcactcgctggaggaacttcatctttgcatatcaggcgtaccacggcctgatctgaccgcgaggacgaatggccggccattaaagggaccattgcacgagggcatgtccatggaatcaagctacacggtgcaacggcaagtgtatgcgcaactaggcaagttgacaaagctgagggagcttgtgctgtcagtgtcgttgaagagtgcgaaagaacagtatggtgaagatctttctgattacgagtatgatactgagggcgagcaccatgacccgagcttaccacaggcagagtgtcagtacgagtgtctgtcgttcacgctggagagtggcctcgatctactgcggaatctgaaagagctgcgggtgattgatctgagcaatatggcggtcggcatcgatggcgaggcagagcagcgatgggtgaaggagcattggccattggtgaagcagaaatagacatcacgcacacatcttttgaataggtatcgttcccgagttacatgagcggcgggcttgatgaggttaggcacatggcttgttggcatttgcgcttagccgaatttgtatcctacacccgcatgaccttcatgcacctatttggaggaacgccgcgttaaattcttgatcgaaaaactgcactgacccccattttgcctgactgttccctcatgaacagacgacatgccaatgtatttttagactaggcgctatctttcctttgcctccagtccagcacggcgtggtggggctatataagcagcgtcaatcccgatctcatcattaaacgcccaaacattttttgcgctctaaacgatgcttctcaaactttgcttcaccactcttctcgctgccgtggctgctgtcctgctggcgaacacagcttcagcttatgagctgtggtaccaacggtgtggcaattcgcacatattcaaaaggaccattgctggaggtattgtaatgtaacaggaggcagtcagaaagtcgcgtccactcgctatcaatgctaatacacccgggtcgtttacgactggggtggtgcgtttcatgtatagatacttgtgttactttggacagtatcgacaaaaaattttgcaagcatgtgccacacggcaccactggttgcaagcgatataacgacctggagtgtgagttgaagggtaccaagctgcacggctccatctactgtgttgagccagaggcgtaactgtttcaagatctgttatgtgcgaaccgtacgatgaacgacttgacacgcgagatgctcatgactggggcatcgagaaataaactcttactggtctcaaacttttgttatcttggcttctttaacaatgtcctcgctcttgaaactggtcgccaggcaaccttaaacatgctataaagattatttttgtatctttgggacaggctggttggcgtttgcagggaatcgtgaactgttcaaccgctccgcagacgcagcagctgaacactttgacacttttgcacaatgatgagtggggacaggagagataaatggctcgaagggaggtttgctgggagtcgacagacgctttttcacttggtgcacttgggacttcgctggtatagtcccgagcttgaatgtaaggcagtcaggccatcttcattcatctacagaattccatgcttgcccatggtagcacaagcagctgcagagcaacatcttgtgcttgttgacggtagagacaactgcgagtgccttctcagcgcggtaacaagatgctataatattgctcctgcggccacctcgcgtgccaggttgccacgcttttcgcgtttggtggcgggtgcacagccccatgaaacacgaaaaaccttatcacgcttaccgtgtggccgcagtccgcctctccttttaaaggccgggaagggcggcgtgcactccattggagttgagctctgatcaatcaggcgcgcattggagttttcctttgtcccttgcatccgcactcctccgcctgtccctctgcatcagcttccatcgcattctctccgcttcggtcattgcctcattgccttacaaccgcacttgaccatagcgagctacatcaatctaatcagcacgtctgccgctcacgtataaaacccagcgcactctcccctcccttgtctcttttccagcaagcagcaacacccgaagcaaaaaacatccctcgaggttaagaatatcgaaacgccatggcagcgtccagcaccactacgaccaccaccagctctgcctctgacagcgaagccaacgcctactttgagactggccccaaccaaatcctctgcaaggtatggcacctcggcctcacgtaactccggacacgctccagatcacaggtcctcacgtcttttctcacatctcatcatggctctacgtttgccctacctctttcgctgatcaactaggtttccggactggaacaaccttctttccctgaggaatttgagcactcttgggacttgaagcacgtccgcctgccatgctccgacagagctcacaaaaacgaggattcgctttggccccagatcgttcagagtctgagtgagcccatcttgaactcacagcaactttcgcaagtcatgctgggatggaacaagtccaaggagcatctctggaacatcaacgcactggacgccttcctcaactaccgtagtgccgcagaatcggccctcgacatcgacggcaccctctcggatgacgtgcttgaagaatccgaccgtttggctcaggctgccttggactctgacgatgattttgggtccatttatgacaactcggacacggagcctgagcacgaacaggaacaacagcagcatcggcagcaagctcatggggaacaggacttggatgcctcggcccaaagtggcagaccccttcggagccagttcctgagcaccttggaacgacagcatttttttgacgtgacgctccctcgcatgcaggcactcgcccttcgactgcccgaattggtccccaagaagatcccattcttgatgatgcaaaccgattcggccatcacgctctcacaggaacagatcgcttgcctactcgccaacgccttcttcaacactttcccctctcgaaacgcacccttcaaaagaggcaggaagaagaaacccgcgttcgccagggccgcctcgggtggggatgtgagtcagcgacagcagcagcagcaaggacaaaatgaggacgacgaggacgacgacgaggacgaggaccagtcagaggatgaaaagttcaagggaaagcaggcctcacgtggaagcaagaaagccggtcgaggtggcaatggtcatggtggcgctgccacctctggtcgaggtggtcgaggcggtcatgtgcagggtcgtggtggtaagagggccttgttgacagcgccccgaaagcccaggaagcttcgatcgtcgggtccagcagctcagtttgagttctttgaaaacgctcccggcacatcctcacctgctgtggaacagcgtctgtcggccagcgtgaaatatctctcggtgaaggagcttgatcaggaaggcgatccggcaaaggaagcagataaagtgcaagaggaaaaggattatttgcccaagatgccctccatcaactttatcagcatgttctggagtgaggattctcttctcccttgttcgagttcccaggcggccaagctgcgctgtatcctgcactactttgatcgagtcacgacagaaagtaagtcaaaatatgtccttggggggttatatatattgctggaggagcctcgctttttgagcacgtctaacacttctggcggatcctattattagtgcctcaagggacagtgacatatcaccgacaggtgctaaagaagcccgcctatttgagacccggagagcgactgagtagccttgactttgccctgtccaacgtcaccgtggatgcctccacgcccattgaagatgcccctgaaggtgccttgcagctggatttcgccaacaagaacattggaggaggagtcctcgataaggtacaaaatagggtcgttgcgcgtagtcctgtcatccgttcaagtcgaatcctctgtttctaaagctgatactgatgtttgcactgaatctgaacagggagcggttcaggaagagatccggttcgtgatctgccccgaacttttaattgcacggctcttcacgcagcagctcgaagccaacgaggctgtcctgatcaagggtgctgaacggtactcgaactatattggctactccaagacttttgagtggtattctgatcacagggatctcacccctcggtaaataggcattcacaaatttttgcggaggaaattcttgaggggagggaaagagaggacatgactaacaacaggaaacatcatccgatgtgtccattagtgacaaactgggtcggcgcatgaccgagatctgcgccatcgacgcacgccccttcaagtctagggtctcacgactggagcagttcgaaaagcactatctcttgcgtgaaatcaataaggctctcgttggataccgcatgtcgcccatcaactcttcagagtggggcatggccaaagccagcgacgaggacaggatgaaagactgggacgctgtgaatcggtatcgccctatcacgactggaaactggggctgtggagcctttcatggccatttacagctcaagtttgtccttcaatggatcgctgcctccatctgtggcggatttgatccccagaacaagcggttagggcaagatgttctgtactatacttttggtatgcagcaattggctgatgagattgaagagtttgtgaaggtgatccaagctgccgacaaggtcgtggaacccagtaagtacctgttttttttaaagagagaggtgactatcaagtgtttttaaacatgtgttgacaaccacttgttcctggtccttgttcttgcgaaactgttagagcggttgatcgagtgcatcttgcagtacccccgtcgaaaccccgcaggcgagatccagggcttcagagaaaagacactactcgaatacctgagcagcgccatcgcgttcgtggcgtaaattgggtagttcatacagagcgctgacatccatgctgacatccatgaatgaataaacactccaagatggaactcgactcacatatgaggaaggggcagaggattctcagtttttctttctttgtggtttccgcatgagggtggctagcatatccgttttggcagatcgtaccatcctccgccaatatgcaatgtttccagcttctccaaccccgagagtcgttccagaatcatcctctcgagtgccgatcgtgttctcttggaattatcccgcttttcctcagggggcagcagccgatcgacgcataggtcaaatgtaatttggtccatcggttttgtttcgtccatatccttgatcctgagcatgagtcgtctcaaatccttgcagacccattcccctgttggttcgtacggcttcagagctatatttgcagcaaatgaggacgggctggattccatggatagctgagaagccgcttctgttgcaccatcctcctgcgtaacagaggtggacacagaaccgaaggaggtacactcttgaagtggatagggtatctccagggtcaccagacgcggacacgtctcgaacaactcccagatgttgaaccgaaagacccctccgacattctgcggttgcctaaacttcaaactgctgctctcgtcgatcaagactagatgttcaattgtccccgaatgccgctgtactatggcttcaaaaaatgcgtccgcgatcaaaacgggcactaatccctcgaaagagaccaacacccctggcgctggtatcgtctgaatgaagcttaggaactttgctggtgcggagcaagtcgtcagcatggtcaaatgtgtgattccctggcagctgtctccgcgttgtacagactcgtgcaagtctctgaaatcgccatgtagtaaatgctgtatgctgaggtgggttagattgaggacgtgctgtaggatgggtggaagaatattcccgacaaactctagcgtttccaatttcccgtgcttgaactcgtagagagagctctcttcatgacatcgttgctgcacgtcactcccgatggtttgatggtcactgtcgtccagaacttggccttcctgtcgaatggggcccaccaaggctcccgactctacaagcgcctcaaccgcatccagctttagatgtgtgagctctgggcaagcgaccagtattcgaagaaaatccactcgggacacggcccagttccagagttcgatggtcgtcaggtttcccagatcctgaaacatggtggcccagagtcggaaggctcgattacccaagtgagtgtgccgaccgtaacaccgccaacagagcgtcctcaggctatcgcgatttctgtggatgatctcgtgcaagcagccgcgaccgccgtcctcacggtcctttgatccacatgttgagacatcgagctttgtgaggtgtgccaccgagggctggttgaagactgaggtgtcctcgatgcgtcctgcagagaggatgcgaacgtgttgcccgtgctttgcaagcgctgcttcgtggcagcgggcgagcttgtgaggggagacgctgatggagtgccagtacagcggtagaaagtctatggcccattgctttgagacgagaatgcacagcgcgagatctcgtttggttagaaattgggcgatgagggtgcggatctcgaccaggccgagcgcatggagtggaggtatgggtgattgcacaggtcctggtgggtcgcagcgctggctcatgtcgctcgactgcagaggatgctggacaaggcagggagagcgagagtgagcgagagtgaacgagagagagagtgaatgggagactgaacgagagagcacgatgggcttgaaggctcgaatgactgactgcagcgcatgggctgatgtcaaaaattcgagagcaaggtgtctcagatgcatctttcttaccttggtggcgcatccacatccacgcgtctcttacggctgccgcattcttcctaaaggtctatgggactcggcttggagagtcgcgtctagcttgcgcccatcatactaacgcgcccgagcaacagtcgtgatcacctccctttccacggctgggcaccagagtgctacgccgacgctctgtgcgatagaactcatagaagactgttcatgcagcgagttgcgtcgtattccttacctttgacagcactcaccaaatatgcgcggagcacatgtcagtaagccttgcttacattcatgcatcctgggggttgcgccgactcgagacttgcatgaaaatgcattgcgaaccccatagaaggatgggaacgggtactcaggcatgagttgtctcactgtgtggaatagttcctccgcctgccattggtgtgtcttttgttgatttgcctcccggatcgcccatagtgtgtcgcttctcatgccttggcgcaatttggctgttcgataacgcgcgctggtgtttgagggtcgtccaacgctcggatgtaggttgaaacgttcgaaaagtacatgcactccgtttgaacatgtttctttccgttcatactccccgccatgtaagatcgatgggcgcccgcgacagttaaaattgcacgtgtagcgccgtatgaaacacatttagagttatggcgcccgcggtatcctggcgtgcgtaaagcaacctctgtgcccacagcggcaaaaaaaataaaaaaaaggaaggacatgcatgcatcatgctcatatttaccgttgcaaggtcagtccaccaaaaatggctccgaaaaaaaagaaaaaccatgtgcattgagagacgctctttttttcctgacacacatcctacagcacacttggcttcccgcacacaccttctcacgctttgctgggtcgttcttccgagacaagaggtgcgtcgttcgcatcaacatcatgctgtagttctctttttttttggagatgtatttatggaccattgcattggtgcctgagtgcctggcaacattttgtttttactaactcaatgctccctaactctaattcgtcaaaaggtacaatacaggacacaggaatgaatgcattagcacttggttaacgtcttgatacatttcgcagtagactagactatatgagcaggaggacctacctggttgaaaaagatctaagatggctccctatggacgtacaagtgtatgtgtagacatgcatccactatccagatgtaatcttttttgaacgtcctgatcgagacaccatctgaacgttcagtacatgggccatctccgttttccactcggccccttggccgacgagatgatgcatcagagcaaggggtgatgtaacgcaggaattggtcaattagtggatgaccaggtatcggcagaaagaggccggcgtcccggaagaagaaataggttgcatcctgggcgcaccatccattcacagggccttgaaacccaaaagtctgcggcgggagagaaaagagttgcaggaatgcagaaaaaaagaaatctagaatgcatgattaagcagtgagagggtagactagcgaccctcgtcgtctttgtgggacgattgtgcataggggttgccgcctgacctggccgttgaaggggaatgtgtaacttgaccatgcagagtaacagattcgcagtgtaaaaaaagaagtgagcaaaagtggtcttcgtttttcttgcattcgagccgtagcatgtcatgtcaacaaatggcgtagtgcagggagcttcctatagcaacgactatgctgcagtaaatgcgtgttcgcgcagcgcagcaggcaatttgtcatggagaaactaaagagagtgccaaatcgattgcatccatctactgcacaactgcccttgatgcattaggacgaaacgcctcacaccgaaatcgccgaggctgtcgcaagagaaaagagatgaggcacagcgtcctgggacaacattgttgtcttttctccaaaatttggagaaaagggggtgtgtgtctgatagaaacaactggcgattacgatacactattctgaaaaacagaaaacccgcggaggagcagaccgacacagccctcgcgtattggagtgccttttttttctgcgcgtagtaagagcccgtagcttggatgaggagctccccccccttttttcggtaggaagggtcctttcagtggatcatctgatgttcatatccccagacctttgggccagagatgcagcttatttccttctgtcggacaacgagagaagaaataggggtcgggctttcctgtcagagcactacaatactgaaccaattgcttgggaaggcccgagttgacccaaaaacaaccagactcatccaccaatagagaaaaaaagggctatttgacattgtcccttcctcggagcccccttgaacgacaacgtgcaccaacatatcaacaacgatcagccttcgaggcaggagcaggagcaggagcaggaacaccgtgtcacgttgcccattcgcgggtagagtgagagtcgggtaccgaaggtcgcactgttcgggcgaaccagctgggatggcgtcccaagttcgaaaatagggggggtagatcgaagcaggagcatacctcctcttccaccgccatgagactggttttgcggcgtcagcgtgggtgttccgagagggataataaaaaaaaaaaaggtagtgcatgtcaaaaaaaggggggcacagatgggcgggaagatagtagaccacgcatctcaaaaaagggcacaactcatttatgcaaggaagtcaagaggaggccaagttacatgatagcaggctgctcgtgcttcccgccaggatcccttgtcgcattacttttagattctcctccccacatggccttcagaaattcacccgacaatacaaaaaaaaatgatggacgtttgcttttcaagggcaggaaatctattgagcgagcaagtggccagtacactggaaaacaacgaagccaagggatggagagacccgataaggaaaaaaaaaaggcaaaaggaagaaggatggagcaaaagggaggggctgacactatttctgtcaaacggaatgaagcgctgctgtatgtaatggcctcgggttcctgtaagcaaaagaagatacgttgatgccagccggtgaggctcaggtcgctgctgtcaccgcgcatgttgtcctcgccaaacaacgatgagatgaaggctcagtcatggtactcttgctttatgccagtaagactgtaattgcaatagtaaaaaaaaggagtgaaatgaacagatcgagaagatgggatggttcgtgcatgccttcatgtatcatttgcaggacatgtccactgctgctccaccaagtcccttctgtggtcactgacaaagactgatcgatggctcctccactgtcattgcttacatcctcgcacacgtcgtctaacattcctgtgtctgggtcgcccgatccaacgactgtcagagtgactcgagcaagagagcgcgcccagagtgaaaagagggagttctttaccgccgccatggcgctcctcattttttttctagtcccgctccctcggtgtgcgagccagcatgtcaatcacggaagccgtctgtgtggtgcgcggccgttcatgcaaggctatatgaagccagaagtgctctcgcccattcactccttcgtacctttgtgtacctgttcagccaaggctgcagttgttgtgtacacagatggacccctctcccagcacaaggccgtttgtgccttcacactaacgaaggctcgtgttttgcactgacccgtccccaaatgcagcatggttcggactgaattatgaatgacgggcgggaatgaatgctatcctattctgtcggtcctcgctattcactctttggccccattgactagccgtgtccctcgctagtcgcattgagcgttgctgacccccatttccttgtccaacatcaaacaaacaggtatagacacgcaccacccaccccttctttgtgctctttgttcttccttccatccccccccccgcccatccacccaccctccccttctttttttttttttttttgcttttctgtttctcacacacctctctttttgtctgtctgtctgcttctctctctctttgctctctttctttcattctttttcggcacctggcagcctattgatcaagagaaagctgcttccacaaggtagacactcacaatttatcaccctcgccttttttttttctttctttttgggcgtccttcatgggcgtgttttgtttgtgtcaacaaccgtaatacctcccttgcaacagcttgccgctctctctcgctctctctctttctctctctcgctcgctcatcaacccgtgtcctcgctcgtcgttctctgactctaaaacgcgttcatacaactctgcttccatatcgggtctggttgcctttgccttttcgtctttggccctttccctgctttcctcactccgtcttgtcttcctgtcttccttactcacgttcactctctcactctctcactctctctctcactttctcactctctctctcactctcgcactctcacactcgcactctctaacacacacacacaccttctctcgttttcgccttctctccttctctcctctcgtctttcctatttgaatgcacacaccacgacctccattcccccattcacacttcgcatcccttcatcccttctggcgtttggccgcattggcccaaccacatcactcccacccttgcagccagtgaggtgcctcctcccgctctcaaccatctcgcacgcactcccttggccctcgacacaaaccgtccgtctcctctgctcctgctcttaccttggtcccccccacccgtccttgcccaacctctcgtcctcctccttttccggcccacgtccgtgcgcctgcgagccacttgtcagtctcgcctccactcatcctttcagcgcgttctgcccccgtctgacagtgcttcattgttccttccggtcagatatagccaatacctcgacaccgaccttttccgacgtccacggcgtattcgcgttcatcccctaactccgtaccatcaaaaaaaacatctcgcgtccttagccgaacccttgctctctctgcctctctctctcactcttgcatactcctatactcaccacctttgctagagcaggtcacttgctctgctgtctctcgctctccctcgacccgacttttctcgccgtcctcttgctgcgaggacatacctcgccggattcccagccagatttatctatcttgtccaacaagaacatgactatccagcatcaatagcagcccacggtagcaacctcacgaccccctcccctctcatcctccccactcatccttctgcatctgtcatcgccctcgctgtccctcgtcctaccctgcctcctagtgtcgccatgtcagcgcaaaacataagcttcccaactgtggactcgttgctcgccaacacacttcagcttcacagacaactggacaagagccattcagggacgcctagatcctcaacccagcagcaacaacgaggtcagcagcaggggacatcaggggggccaggaacgcgcacaggagcaggggcgaggatagtaacaggagcggatggtccgaccagggcagacagcgcaccgaccggtcttggactgggatcaactctaattgctggggataattcaacgtcaatgccaacgcacggccagagcagtaacagcggtgctgcagacacaagcagtcggtcctatcctgcttcgccatccataaatgccccaggcagtccccggccgttggccatgatcggctctccgctgatgtccctacctccggagcactcctcctgcccgtctcctccctccacgcccacactgtcgtcgttctcatctcctcatataccacgccttccctcagcctcaacttttgtccccggagttgcgcagctgcagccacaaactcagcaccagccggacgttgcaccaggccctattcaccctgcagtacctttctccataccgtcaaaagtcagcagcgcgaatagcgacgccagtaacagcactcctgtcccttatacccgatcctacgcgaaaagtctctcggcaggagctcacctacaacagccaaaccctttgcaccagccccagcaccatgtcaggcgcatcaagacatctctcggcgcattggctagtatggacctcaatggtcagctagtgcacccacttttaggacgtgacccaaaggaagactcgtccttgattccgatcaatgtgcgttacgtctccaaggacctgtggatcaggatcgagcttcctcgaaatattcccgtcaacaaggccagagatctcatcctccaaaagtgccagctcacaacggcacctccgtcggcaccttcctcggtggctgacacagcatttatggaggatgacctgactctgctggcagcaggaaggagagtcgaggaccgacccaaaacgatcgaaggcaaggctgtaaaacctgggcgagcaaagagcgaagccgacggcatcgaaatcgcagcgaggaatcgggacgagggtagaaacgcaagcacagctctggagaggaataaggaaaagaccaagagcaacattggccctatcacacaaaaatctctaccttcttgcgatactcagtcatcggcatcgaacaaatcagctacacaatcttcatctaggtcccactacggcgcaagttcatcagagaagggggctcatcgaccgcatttggcgctcgaggagggagaccaatcgcgggctgacgccttggcggccaggctggagatgtttgcagatagcattcatggatttggcgatgagtctgccaagatcaactatgccagggccatcacctttcaaaatgcgactagcaatcaacagagcaatggtcatgatgcagagtcgccccaccaacagcctggaccaaacaaggcgcagcaactgaagcgtctgctctccagctcttcatcgcagaacgatgagagccatggcaccagtccccccgaacgtatccatcgagagagcggcacaaacagaataggacaattcccggtctggagtccatggagggatcgacacaacagccatcctggcaaacactttgagcgtaacatgcctgaccacagtgacatcttcctcagctgtcccaaggatggggaccacattcaccagagcgaggcgatgagaaaagactgtgaagaatggaaagcctcctttggactcttttgggttgcagcagtatgtcaaccctcgcatgcgaaaagacatctcttgaattttttttttcggaacgagcgatgctaaccgcagctattatactctgtttccatgaacagggtcactggctagacgactcgcggttgatcaactcttacactttacaacctcaggatctactcgagcttcaactccggagccactacatccagctacctcctccgggtagtgatctcaactatggcgaccactacgcggaaggaactcttttcaagctgtccaagaagagcaaatccgtcagcatgctttcaaaccatggcggaaaagaggcactgggggtttggaaggaacgctgggtggtattgcaagggcacagattgcttatctatcacaagcgcaaggtaagacccaagatgcgataggcaaaagagtcgcaatgactatcggtacctgtcgccgcatagctgacgtgtgttttgtccttaaatctcgcaggatacgaccaaaaagacaattgtgttgccggttcctctgacgatcgtcaacagaacgttgcctgcaaactcgcgccaccagttcaagtttaccacaacgagtccagtagccatgtcatccacgatgatagctctcgacatttccacagatcccgcagagcccaaagtctgcttccgaggcatgagcgaacatgtaaggcggctcggatgtgctccgctctcttcagcgcttatcccaatgatgtgcgtacatcagaggtctgacctggaaccgtgttatttgtaggacatcaatcactggacaaggattttccactcgcttaacggtggcaacgcacctgtagggtcaccgatgttcaatcggatgggacccacctcatcgatcttgggaggatccgatggcgcttcttcgaggactgctgatcatggaccttctactttggcaggattttcagcagagcgaaagcggcacaacacgaccaacgcctttctcagcaacgcaacaacggtgccatcgatcaacccgattctgatctctaatgcacaggccgcgttctcgaatctcggtatgagtaacggcagccaggcgggcaccctcaacaaccactacagacatcaaaaccagcaatcgtctagtctaggtgaaagcaaggacctaggcttgctgcagcatcatctgctgacgacaagtccgaaccgcgaggaaagcaggcgtagggccattactgagccaaatcgactgaagctcgtgagtcctcaacagcaacgcggtcattccaagcatgcgtccaagggtagagtagacaacatttaatggtactggtgctcaaagatgtatttgggctttgtaatcatcgacgtcccctctttaatattgtgttttttgttcttagcttcagcgcccgagctcgatattcgaactgtggatgtctccaacgtctccgaggcgccgttccagctggattcacctcccggtcggaaacgtcgccctgtacttggaacagagtgtctcgacaacgcaagtcaggtccttctggcgacttcgagcgctcgctcctccatggccccgctctattctggctatatctggctttacttccccagtgctggagaggtgagggaggctggaaagactggagcaaggccatctgatctgccttcgaaggagaatgcctcgagcagacccaagggttcccatatgtcggcttcgggacgctacgtgaaatgctttgccgccatcaatgaccagggtcagttccattgggtcgaggtcaaaaagcagaacgagaatgaacaggaacttcgagcggaatgcagatcgatgcggtccacctacggtattcagttgcaacctaccaggatggatcagaaggacaggaaaagcagggatctgtcgtcgctgggccaggatgtcaacaggcgggtggcgcgccctctgtcggagccgtcactatcgttggctcctagttcttcggttggcatccaggctacgatggctcacaaactgcggctgtttttcttcagtatcaagatcccggcttctgcgttggaggatgtctatttgaacatgaatgagactcgctcgttatctccgccatcctcgacgagtaacaacattggcactggcattcctgggatcactgccacctctagtggcaacagcagcaggagcaacagcagcagttccagtacgatcgccacagtgggcacgtccaaaccggtgtccactgccagcaaagtccggcatcgactatcgtcttcgctctcgacattagccacctcagcattgccaccgctcccaggccttaagtcgcagtctgtgtcgggatcaaagagcggcagaacgtctagcaactctccctgcaactctatggcgaacgacaaagaacagactgcatatccgcatgcgctgctgcaggacagggctatgaccgcgcccgcatcttctggatcgacccgtgatgtgtcgcacaaaggatctttagtctctcttaaatcgaccctctctgccatccagacaacggcgctccagccatcatcacattatctgtcacccacctctgctgagccattatcgccgtcgtcgccttgttccccaacatcgtccacgtcctctgcgtcctcgacgaatgtcttgtccttggcgcagaatctacagaaggctgtgatgctcagtctggaaagttcggtcagccattccaatgagaatcgtggtacaccaggtgggaacagcggcagtggcagtggcagcagcagcaatagcagcagtggtcaagcgtctcgcaacaactcgccgccgtcatcacagacggtcaagccgcccaagctgacgctgtctgaggctatggtagcgaagcagacgtcgctccccgattcagctgcgacgatggagtactccaagatgatccatcagcaggagaaggagcacgaggaaattcagatccggatccagagggcggaggagcgggctctggccaaggaacggcagtaccgccaacatcagcaattgcagcagctacagcagcagcagcaacgcctacaggccatgcctaaggatgcatcgccagggtctagaggcatgatcgaatgcccgtttttggaaatgagcaaaggcggagagctatcctacgtgacattgaggggttacacggagacggaagatggatggagacttctgcagatgactcttgataggtttttgggtaagcgtccaagatactgtttctttatggagtgggtgatcgctatccgcgattgctcgacaacaactggtgtgttaacatgtccctcactttgttcactggctacttgctgtagacggcccagtggtggaccacgaatctgccctcccgccggaagatactctcattccatcgtaccattcaccacccgaggtccaactgtctgagaaggctcagcagtacttgaatgccaaggcttcattgatcgaagaggccaacatggctgcgtctatggcggcggtggagaatgcgcgaagtcccacgccggacccggtgctgttgaccacggctgcgtcgccctcctcgggcttgcctcaggcaacgtcgcagggcccggtgtcgcaaattcgcgctacgagtgttagtctgactcgatggatgaatctctctggtggagggggtagtgatcgcgagaggagcaaggtatgtgtcaagctgttccatgttccgtccattttttttgattatgatagtgtgagtactcatgcacttgttctttggccctcgattcgcatagaaaacttcctctacccatcgtcagtccccctccgtgttttcgttgtctttgcagggtccgtccttgacgtccattgctccagaattgccgcatcgacattctcatcaccttgacggctcgactgttctcgaggcagggtcgtcgtcctcggctgcttcgtccgcctcctcgtcgccatcgcccaacggccacagctctagtccgtcctcgggatcagggcagggcgtcgttgagcctagcaacagcaaacgaggtgtgtcgccagcaggtgcacattccatgtcggtcggtgcgggcacgagtcttttccgtcctcgaccccgattgatcccacagcgttcagccgatgagttatcaaagccgtcgtcgtcgtcgtccaacagaacagaatcgcgtcagacccagggcaggcggggtcgtgagatggccaaggcgttttactcgactgcggccgcgatgatgaacagtggcagcactcacaacaacaaccacagcagcagtggaagtgggagcgggagtgatgtcagtaatcaataccagcgcaaccgatccaagtctcgatccaagcatgctcgtgcgcccttgtcgaaaaacgaggcgttgttgtccgaggaggcgcgggtgaagaacaagtccagtggtggtagtagcagtagccattttggaagtatggtgccgagcagcagtgcgagtccgacgccggattacgatgacttgttgggaccaaggtccatgtccctgacggccgcgacggggggttatggcgcacggacgatggccatgtcgacgtcgttttcgtccattggtgacgaggccttgttccgtcgtcatgagcagcatccgcatcagcagcaacagcacccacagcagcgacagccgttggacccagtccaccgcactagtgtttattcggagcactcgccatcccacgacgatgcctcgacgttgaatgttggccatccagctgggggcgttggactggggttggatctgggctcgttaagtccacagcaaggcggcggcggcggggcaggcaggtcggaagtgcctagggtgcattatgaaggaggcacttatgaggggtcgagcaagggacacaatgcccacaacgacggccttcatccgctggacggtattggattgtcgcggaatggcgatgatgggtcaggaggcgcaggaagcaaagcaggaggccagactggcaagaagcatcagacggtccttggtgccagcaaagcggctgttagcggggtgtttggcaagttccgaaaaagtgtcggatgaattctttttcgggtcgtctcccacgccagaacacacacacacacactctctctctcacacacacacgtacactactctcgtttttcatctcttagttgtgtgtttgttgctcattcctcccccaatctccctcctctgttttcctttcttcattttttctttatgttcgcttacacactttttctctctctttctttcgcattttctctctgtcagtgtgtgtgtgtctcccttctctgttttatgtaactcatccctggcctatccccacctgcatatgcatgtggtttaattgaccaatctgccttgcagtgcttttttttctttcttttccttcaaactcccttatccattgtacatactatgcgcgttatgtagtccttgaacaaatttgtaatacagctctgaatgcatataaaaaaataaaaaaaaaacaaaaatcctattcgaaagagcacaaaagcagagaagaagacctgctctacagctatttcatcatttgatgtgtgagcgatgacccatttttgttactagaaaaaaaaattaccatttcctagtcagttatccatcgtatccttgttcccatttttaagtggggggggggggggggaggggcagtcaagtgaaagaggggaaagcgaaaaataaaataaacgaaaatgcatgggaatccgtttgtcttttaggaaaaatggtgaagaaccattgattctagatgctgaacgacgggacgggagaagagggattaagctagccaggttagagttgatgcattttgttggcccaagcgcatgatctgcaaaatgagctacgtgatttttttttttgagttgtttttttttattagagtgtgtgcgtgtcctctgtacctgctcccgatagcactgaaaaggaaagaggagaggagcagagaaggcgaggagacgagaagaagaggagaagaggagacgaaggagaagaggatactcgggttgaaggaagagagtgatattggtctgctaacgggcagataagaaataaaaaaaaaaaaaaaaacacgttgtcaatgtaagagcctggattgtgcctttgatgagagacctgtcaagtcacaacaacaaacggttcgcgtgtttcgtccttgaaatgattttgaaacagacccttccttctgtggctggatatgaacaaaaagatccaacctagcgtgctttttttttttttttttttttttccttcttgttttcaaggttgagcacaacaagggttgttgcatcactcccgcaatttttttttttttttttttcatccgcggatggctcttgtctttttttttttctttttcttttgttcattctttggtgcaagggcgcgaatggggatgcgcttgcctctgggctgtgatgttcccttgtgtcggatggggtttttccatggccagcgcgagcgcgcgcgcacacacacaaagacgaaacccaaagagcgagagagagacactgacgatgcggagcgagacaggctgcagagacagaccacggacgaagagagaatgaagaggacgaatgggagagaaggggtccgttgccgggggcagaagatccctcgaggatgcagtgtgcacggatgtgtgatggccgtggtgatgtcttttctggagcggtgtttgcaacaacaggtcctgtgagcgatccttttttgttctttgtcctcctcgtctgcattttgttatcctttgacccttgacgttctttttcttctcttcctctctcactctctgtctcgttctctcacacactctctcttcgccggcgagtcgcctgtctgctgcagctcctctctctttttctcgtcagcctctcctcctcctcctcctcctcctcctcctcctcctcctcctccgtctctccttggcctccatcctctctccattctcccttcggtcgcccttcctgcatctgatctccctgctcgaatggaccagcacccagacacacacccgcacccgacagaaaagcaccgccatgacctgcccatgacaatctcacagcccacatcaccagctgcatcacctctagggacagctaggccatacgagaccgcagaccctgccgctgcagtcccgccccatcacacggacaaccacccgatcgagatgcacatccaccccacctacgcgcagcctgcggatcagctcgactggagcgacaacgacacctcattcgaaagcgcgcaagacagcagctccagctggggacaacatacagccatggcgatagcgcagcttgctcaacatggtccgcatggtcagcatagtcagcacgagcagcaagagcagcaagggcagcacgggaagcacaggcagcaagggcaacaccagcaggagccagtgcagcagccaaggcaagcgcaatacgagcaacagccatggcaacggctgcagcacttgcagcaagcacaagtgcagcaagagcacggcgatgacagggatgtatccggacatgtcggtgctggcgagggcgcaccgtcgtcgtcgtcgtcgtcgtcttgtgcgccagtgcacgcacgctctccgtccagcctggcgcaaagcgcgcaatcgctcaagcagcaactgtccattctgcatcctgcactctctgcgtcgtcgtcgtcgaatgcacctgccatctacgcgctcacctcctctgtcccgtaccctaccatcaatcagctgtccatgagtctgccccacgcccccatcgcccccgacaccctggccatgcctttcaagaccgccatgggtccgccagccacaacgacggtattggttcatgccgggtcacggactaattccgtcagtgccagtgtcccgtctttttcgtcgcccacttctctcacctcgccttcgctcacctcgcccaccggcagtctatcgcacaccccacaccacctcccagcctcagcaccagcaccagcaacaacagcacccacatccgcacccgcatcgatcgcagcttcgacatcagcatccgctccgtcctcacgacagacatcacgcacaatatcaacaacgccctttgcacctgctgacggtcgtggtgttttggaggggtccgacatgtccatgagcgggcactcacaggacgatatccatccttactttgcggcgaccaacttctccaccgtgcccaactcgccccaggaccaacgattcggtcccagctcacccacgcggacaagacccaattatgtcagtcacagcaggtcgtccctgcccagctcgggtctgacctcgcccactacctacttcacacccatgtccacagccgcagccacatcctcgtcctcacccaattcagcgacagcagcagcaccaggtgcgctcgagcacaaagacaccgttggatcgagatcgtccatgtttgaatttgcacccgcgtacaaccaaggcgatcaccagcaattgaacatgcacgcgggcaaagaccgtgtccgaccggcatctacaggagcagactcgcaccagagttttcagagccaagcccgtcttcagccacagcagcaacagcagcagcagtatgaatcgccaatgtcgtcgtcgtcagcatcgtcggccacggctcggacacgaacagaaacgacgaatgatgtacagaattcaatggcgatcccgagtgctcgggcggggatttctcagaatttaaccttgggcccgttgacgaatctgaagacgagggacgagccgaatctaccgacaacagagattctagcggccaccaaggactggagcacgacgggacttggacccaggtcttcctggccaatggagctgcttgtctttgtgcagatgatgatgcgatccgagtccccgctggctatttactggggcgagcagtgctaccttatttacaacgaggtgagtgagggggtgtcaatcgcctctaagtttctccatttctgcgctgctgtgttgtgctacagagcatctgtgattgggaggaggaggaggaggcggagggggggatgaaaagaggggggatgggggttggatgggaggagagattgttgttttctatggtggacagtacatcctgtggagtaagcaggcgaacagtttgtattgcaggctttttcaggagggatgcctttcgtattccatgtgcgcatttcatcgttcacttccaccccccaattctcctttgcctctacccccctccttgtcctcatttgttttgcttgtttttctttacgggtctgtaaagtatgagcgtttcttgtcgttcctgcaaagatggtttccctttttttgtgtacactacttttccagagttagtttgacaatgcaatgcgtagcacagatgatcatatatccgaccaaggtgctcaagcgccaacttgtgcgagttgagtgactgagaacaaggacaaaaaagccaggagagcgatcgggctttttttttgtacactttggtttagattatttgaattggaatatcttgagggtgtgcatcgtgcagatatgcatttgggtttcccgttcagttgaaacagaatgggtttagttcgcctttttttcatcgtcaagtgcatatgcgtgcagtgtgaatgagccagggcgagagagagtgagagagcgagagagagtcagagacagagagagtgagagagagagggagagggcgagggagagcgcgcgaggtgttccaagccaatagcaaccgtgagggaagtgaacctggtgccccgctttaatggtcatcctgtcgaggtcgcgcttatgatgttggatttcgatgcggatatgacagcatcaatcgatcggggtcagggtcagctacataggagggaaaagacaatagaaaaacgtgttttcacattgttctcatgaggcacaagcgcgcaactgaaggacaaaaagggtgcgaatgaaggctgaagttcaatttaggtttgcgatatttttatttgtcagatcttgcccatatttgatcctacaaggatccttcctgcgctttggacacccattagatttgtgctcgctcggcggtactcattttcttccgccctcctctcttcgtggaaacttctttaggcatggcgtccgatcttgaagcagaagcatcctctcggtaagtgtgtgcttccgggtcaaaccactcacaagctgcagctgctttggatgttgttatatgcaacggagtcgagacgcggtatgaagttcttatggcacaggtcactcatcgataccgccatgaccaatactaccttcgatagcaatgggtgcaccagggtcaacagtatgggccgagatctgggatgtgatcggggctcagatggctcaggtcagacgagatggtcgtggttacggtaacaaggggcttcgactggatctccacaggtaagtggactcttcgtcctacccgctcacgcgtaaacacatccaggctgttccctaatgcatatcgctacacatatctctgtatttatagagagggttacgaagaggaatgttactttgactttacgttttcgcccatcttcatgcgcgatggctcagtgggaggcatttttgcggacgtcattgaggtgaccaagaacatattgaaccagcggcggctatccacactcaatgagttcagcaagaaggcagccatgattcagtccgtcagtggcgcatattccatgatcacctctatactgcacgagtccaatatcctggatgtgaccttctcgctcgtttacaagactgtggagccagccaaagacgaacaccggcaatttccctttggaccctattcacccctcccatcgaagcccagcctgtcggccactcacagcagcagtagcagtagcagcaacagtagcaactctcatacagcagccggcactgctgatgctgctactgccagttcgtcaaatcactcgcttcgcacgcccgcacaggatgagtttctggcggcaggatcccctgcaggtatcgacctagacagagagggtgacagctcggccatgtcacaaattagattgatccgctctcacttttgttctggtgttcgttcagacaaaaaagacatgcggagggcgcctcaggcggcgatcctctgtagcacgtcgttcgatcgaaatctggaggtggtcaattatggtggcgccaatgagaagatcttttcaaaggcaacatccattagacacatcccggactctctcttaatcacgcccgaggaatatgaaccactcgacccagcggctcccgtctacgacgacccttgggcgtggccggtgcgatcggtgcttgcggatgggatacctcggctggtgacgctcccgaaatcggagcacaagctggcgagggcactcttgctgccagtgttggaaaacccgtctgtcctcgagtcgcggattacgacggtgttgattgtgggcatcaacccttatcagatgttggataaccagtacctggattttttggcgctgttggtcgccaatatcgcgtctttgttgcattttggacagaaccgagaagatgagaggaagagcaatgaggcgctgttcgagctcaacaaggccaagatctccttttttcaaaacatttctcatgagctgcggagtaagtttgagcatggattatgcttgtccatggctatgttcatttccgccacgtccgtctcttctagcgatactaaaaacttttacttttttctattattttctatgctttccactcagctcctttgacactgatgatggcaccgctggacgatgtgatggatcaaacacccgagaatgctgtgacccgacccaacttggaaatggtccgcaggaatacgcggcggcttcttaaacttgtcaacacgctgcttcagttctcgaggatcgaggccggaaagggtcatgccatctttgaagaaacggatctgaccaaggctacccgagagatctcggccaactttgagagtgtggctcgtggcttcaaactggactactcggtcaactgtgaagatctcgacaccattccgggcgggttctgggtggatcaagccatgtggagcggaatcattctgaacctgatcgggaacgcgctcaagcacacctgggagggctccgtgtccgtccaccaatatccatgcaagggcaagaatggacgcgacggcgtggcgctcgaggttcgggacacgggtgtgggtattgcagcagagcacctgcccacgctctttgagcggttcaatcggatagagaacaaacagtcgcggtcacatgagggcacaggcattggactctcacttgtcaaggagctgacagaggttcacggcggtacagtgtcggtcacctcggtggtggataagggctcgtgcttccggttgtggattccagccggacgtaatcatcattctagtgcccaggtcaagatgggtgatacccaggaccgtacatcgcaaaagtcttgcaagagcgagatcatgaacaacaagacggacgcatccatgtttgtggaggaggcctcgcagtggatcgcacacaaggccgtgcctgggtcgacgttaatcacgagtggcacggattcgactgaggaagatctgcccgaggcgaatgacgatgccatccatgtcatacggggccatcctaccccgtctgacacctgcacagattttgaagtctcgacgttggatgtggatgaggaggagctgtcccggatcttgatcgacccgccagagtctggaggcaccatcgtgcccgggaaccctttggcccagaagcggcccgagagtgcagcatctcgacgaatgtcttcggccagcaatggcaagaggcttgtggcttcggagctgacaggtctcgccttttcggaagggacggggtcgacgatggatgtccctgacaccatgtacgagtgcagcgtgaatgatgatggcggatatggcggtcagattcagaccaaggagctggcggatgagccggatgctgacaaaaccatgctggagagggcgaggtctcgacgagggtatattattgtggtggacgacaacaatgacatgcgggcctatctccgtgaaatcctgggcaaggactttcgggtccggtgtgccgtcgatgggttggatgccatgcgggttatcacgcagagagtgcagcaaggaaagcgtatcgacctggtcctcagtggtaggtggtgtgatgaacgatagatataacttcaacgccgtggcaaaaaaaatgagatatgcctgatcgtgacaccagactaatctctcttctttgtcattagatgtcgctatgcccaatatgaacggctatgaactgctcaagcggatacgcagcgatagtgccacgatgctgacgccgctgatcttgctctctgctcgtgcaggagaggaggcgaatgtggagggactggatctgggcgcggatgattgtcttgtgaagcccttttccgctcgagaactgctggcccgtgtacgttcgacgatccgactttcggatctcaggcacgagctcatccgggaacaacgccatgcgctggagatgaagcagctgatctattccatctcggtcaagatcagaagtggactttctctgtctgggatcttgcagaccgcctccagtgagctcttcaaggtaaaacttggctacctcggaaaaagaagtagctattgctgaagaaattttcttgtgatttgatttcatttggtgaagcttattttttttaacacttgggattctttctatccacaggtgatccgatgcaatgcgatccgcatctgtcggtttaggaagacagatccagagacaggacagcattgggtgagatttgtgtcggagattgttcgcgtgggtcgacctaaggtcctgtcaccaacggatcgattgctccccaagggtctcgaggtttcagaggactatgtcagcaacggtagcgaggtcgactctgctggagatgttcgtcaggtcaacaactaccaccatccaattttcggggctaagagctttctcagtgtcgcgttgctttacaatggcaagatctggggctacctgctggcgtccagagatgcggatatggtcgattggtcgcagagcgagaagctgttgtttgagcagactggaaaccagatctcgctggcgattgctcacgctagcttgtgggagttgaaaaagtcgcaacaggtggaaatggaagctgctcacgcggcgaacgaggcaaagtcccagatcttggcgaatacgagccatgaactgcgcactgtaagttttctttatttcttgtcctcttatgcttggtcagtagtatggatccagtgaacggcaagaaacagaaaaaactaactgccggttgttattatctctgtagcccataggagctatagtgggagcgctgagtgcactggaggacacggctgtcaccctgtcagacgaacaaaaggatatggtgaaaatcatgcagatcaccagcgatgttgccttgagtgtgattaacgacctgctggacacggccaaactggaggcaggcgccatgagccttagcatcaaagagtgtccagggcttgtggagactttggagcagtctgtccgtatttttgcggacaaggccggtcgcaaggaagtggatctgatcatggagccttccgaggatctggaagggttagaggtgatgttgcgacgaggatacgtcatttggactgacggcgatcgtctccagcaggttattatgaacttgattggtaacgctgtcaagttcacggcaaatggaaaggtcgtgacaaattgttcaattgtctcgccgggatcacctcccgtggcgggcgaagctggaccagaggaaccgcagcagcgtccgtcacagcatccacagcagctaccacaacggcgggctcatcaaccggtccaaattcctgcagacgcacaggtgacccatgtgacgtttcggttcgaggtatcggatactggcattggcatcgatcccgactttttgaaaaaccacatcttcaagagctttgcccagtacgaccagtctatgacgaggcgttttggtggaactggactcggtaagtgctagtgtcgggtgcagctttttcttgtgccctagctttcaataccgtccccttaccatatcgctatgttttcaatttgtcaggattggctatcagcaagcatttggtgatgatgaatggcggcatccttggagttacgtccgatgtgggccagggttcgacattttatttcacatggcccgtcatgcttgttttgcccaattctgcaagtagctccggccatccagctccctgggtcatggcctccaagccggtcctccctcctgaggttgcattcgagacgcgtgcggtggtcgttgaaccagtaacagagtctaggcaccttcttgggtggatcttgaaccagcaaaatgtccaggtgacgctctatgagaactgcgagaacgtggtacaggacgaacagcagcggtcgccccaccttattgggccggacggatccatgctgacacccaactatcgccccaacgctcatttctttttctgtgtgcgcgaagcaacagaggagatcacggtcgagaccgcacgagccctaggagagatcttcaagcaacgaaacgcaaaagccagggccagtgcacgtccagacacaaaagatgttattttgtcgattgtgcttgtggtgttttctgctccccgggggcgttcgatggccaaggatatcaaaagaagaattctctcccaggggctcgaggacaccgtccattgtgagtatattgtcaagccggtcaagttggagcgggttgtcgaacgcctgcagacgcttggtccgcatgcacctattgcacggggcatgaccggacagtcgcccgaaatcgtccaggctggcacgcttcagagcggcagcagttctcgccatcggagcaaccgatcgcatcgtcatcaccatcagcagcagcaacatcagcagcagcagcagcagcagcagcagtcatcacagacatcgagtacctcaaaagcacaaagctcaacgcccaacggcttagcagcaaactcgtcacctccgaccagcagtggcagccaggttattcctgcggatggcaacgtgagccttgtctcgagcgattacgaacgcggcaatgactacaacaagaacacgcccgagtcggctcctctcggtccagatggagtcatggacgggatgaacggtgggatttcgcccatcctggagaccagtcgcagtgtaagcccttcgactagcaacggtgcgcgagagcagcagaaccctgccaagcgatcgccatcagcgtccagaaattcgtccaccatgcccatccgacgattgcgccagaagacacctgcgggcgatgctcgacccattttcacgaccaagggcgcacccgggaccgcctcggcagatgtctcttcaagatcatcgggtgagaatccggcgttcagtaaccgagcagcccgagcggcagccggtaagcgtgagcgacgaggaaagtgcgttctatgtgttgaggacaacatcatcaacctccgcgtcgttcagtaccaacttcaaaaattgggatatgacacgcagtctgctagtgatggccaggtcgcggtcgatattatcagagcgcagatggggcagttggaggaaggcgtcgcgtcgatgagcacggatgaaaagtcggcgacggaggacacggtggcgggaggagcggacagcgatgtggtgatgggatccgcggatgaaattgaagaccagccacagcgccctcagcagcgtgatccgatgctcttgcggcggcctttgagcattgtcgacagtctgatcacggatccagtgaacaacatcaacaagagccatacgtttgaccagtcggaaggcgggtccctgtcttcgataatacagtcgacgacgcccttgacgtccccttcgttgtcgttcacgaaccggatatcgaccgagatgcgacaatccttgggctcgtcctcggaaacgttgtcgttgagcttcagtgggacgtcaccgtcgtctgtttcgtctgcgtcgcttggctcctgtctaactgcctcacgctcgcctccgctcggcggcaaagcctctccggatctgtcggtattggctcccttgaacagtacgaggttgagtccacttaactcgagtaggaagcgaatgtcgtccgcgctggcatcgtcgtcgtcgtacgacaaccacccaaagatcgacttgattctgatggactgtgcgatgcctgtcaagagtgggtttgatgcagcggccgagatccgacagatgggagtgaaaacgccgatcattgcgttaacggcgagcgcggtcccgtcgacgaaggagaagtgcattgcgtcggggatgaatgggtacctgagcaagccgacgaagctgtcggatcttgaggcgatgctggatcagtggatcgattgagaaggtggacgagcagagcgagacgaagaaccactgcatcttgtctattccttccatgtaatcttttggaaggctcaaaggacactcgatatgtaaatagcttacgcgcctttcgagggacattcaatgattaaagcgtctcgaccagtgtctctgtgtcaatggtatgattcaggagaaaacgaaaagtgtgcggaccaatagggacaaagtcgattcagtgccgatgttcgcatcggagttgactgttcggggctgaagaggatctgagcattgatgcgcaaaccctctcggccccacgcagcttgtcttgctttattcaaaaacaggagctacgtagttttaccagtcttggaaacgcatccagtcgtagagcccctggtacctgggctctttcggcatcgacgtggaccactcatagaggcgaacaccaccctgcatgtgtcggaggggccaaagtgcaacctctcgttcatgtcctgggaaaggaaggggggcaagcgctaattccacgccagccatcatggtcgaaaaagaccacctcttggaactggtatcctccacgcggttaaagaccgtggcgagaaaacatggctctagtgctatgacaggaggaaaaaggaaagggagagcgtgatgtgtcaacgagttcgtccgagttcgcaggaacaacaaaatggcgtgagaatcaattagaagggcctctataacctactaagagcaggtttgttactttcggacacgtaggttccgacacacaatggatggcctccctcaaagagcttgctatttctgatcacggctgagtcgtctcccttcacatcaatgacccagtcaccatgctttacttccttgcaaggcgactgccccccagacaaagaaagattatacaatgccatcaatctcagttgctgtgtacaaggctgacaaaatcgtagatttcttacttaccagaactaattcgaacggatgctgaccgccgttaacacccatgcagaggttactggcggtattcctgagaaccgaggcacttgccaaagcagcggcagaaagggcggcgagtgtgactgtgagacgcatgttggagctgcgatattaagttttttggggaaggagcgaagcgtgtagaatggttgttatgcaaactggtgagcactgagaacgtcattctttttatacctgcgagtgttgtgacagcggacatgctgtgagtttttttttctgtttttgttcttgatagctgcttgcggcactacaaccaagaagggagtgagaaacaaagagcattttcaaatctcaatgtttacatggtacattcctgcgcgccgctcccagtctcaggcgggatagtcgacgatggagatagggggacactggatcaaatctcgcacccctataccaaacgctcggaccaacatgcgcctgaaggtgacgacgtactgcatactgtacacgtttaagtcccgagatttcattggttcagaacactcgatggatgagaaggatggacgcgatgtggttttttgtttctttgctctccaaactctaagaatgagatcccaacaccatgaagaatcgtttcccaggcgcacttgacggcggtctttggcagcctggaacagagagaaatggaacatcaaagtcgtcggatcatgagtaatggatggatgctataaaccatctctcaacagataactgaaggacgatcttgcagtgaatgtgtcgaggaaggagttccagaacaaaagatggatgtgatgattaacaagtgcaacatccaaatacacgcgacagcctatttttgaccatcaagtcggcagcggctggaattcaagacgcgtttatatggagtttttgtgcccaacacatatgtcatcttcacgctgggcagcttagttctggaaggcacgcaatagctcgtatgtgtttcgagtacgaggtgcctttgagagatgatacctgaatatcactcgcccctctttatttctggacacgagagtgtaagattatctgccttgatagtgcatccaagagtagagttcctggtacatggtttttttgggctttgttgaccactcataggtagggtaatcaggctgcaggcttcgaccggcatgagttgaagcggccacccaggcactaaatgaggctcggaagcgagcgccaatctttgccatcgggcttggtcgaaaaagaccatcttcttgggctggtatctttcagacggtagaaagcgacgtggccgtcgcatgccacaagtcctatagagaatagtgtggagaaaaaaaaacggaaacgaggtgttaagacacagtgtttgcaaaatgcaatcatgcagatttctcagatgagaatacgtcgaacacgatggagaaacgaatggttaggactcaatttcgcacccctataccagacgctcggaccagcatgtatcgcaatcgaatcgatgagttgtacaaaatcagctagaccacaagttctatcatgcaaaatctcaggtccaaggaaagtaaaagcatgggaaggtgatcgcagtgacaggggaggaaatggatgtggtttagtactttgacattctcactgtccccctgagtcacgactttttccagcgttgccaaccacttttactgcattggcctcaacctgcagtgtccacgcagcatctgcctcggatacttgaagacgaagcaactgggcacttgtttcttatcgttgaacgttgtgagaacttctaggactcgctggccattggggaggatctgtaacaaccagatgtttattgagccatttttctcatgtggcgcgttgtcggtacaatgcttcatactcctcgttgagacgattggtctgaagaagttgatgactggcgcctcctacaggaagtccacattcaaaacacctggatgtctccatagccataccgcaatcagcgatgacatactaacataatcagccagcaggcagaagattgttagtataatgcgagtagcacactagttagatctttcgcaagcatctgcaatgagagactcaccgaatgaccatttggacaagtgtaccaatgtccagatccgctcagtgtttgctgcatggccgtaaacacctcggccttttccgccgcggtcagtggattgtagagagcatcccctctggcgacattgtaggcgtcgacgatctttgtctctaaagcctccgatcgttcggtgcagtcctcaatgattcccaagggacaaccttccttgatcgccttgagatcggacatgaaaagttccatgactttatcaacacgcttgagccgttgcttcttggcttcatctttcgagggcatggccttgcgtccgagccactgcatccgcttatacgacagctccatcctgatgactcgcgcgtaagccttgtgcctctcaaattttcccttctcggctgcctccagtaaaatatgggcatatgtcatggcgcaattgatcaggtcttcaataaaccagtaccagccactagaggcttcgacatcgctgaacgctgcaaatgcctgcgccaagactaccagaagtacattggcgagtccttgcagcgagtccacgtaacacgaaccgacttggccgtccaaaggcaatccgcactccaaaatgcaagtctggattacatcagaagccagctcgggtgactgtgctgaggagcggcgatttcttgtccgatgcattgtcgtggaggtcttggctcggtagaggtgtgagactgcggcctcaaagagctgtcttgttggtgacttcagagccgagagagcgagggtcgaaaatcgatgaaaggcttccatgggccacttgagtagctttcgccatgcatcttcatgcgcctttggtattccgtagactttgaacaactcgagaaaatcgctgttcggaaaaggatcgctttttttcgtgagtttaccaagtttccggacgcgcagctctggtggatccgggcgtatttcggctttggtcttcttgatcgactgcaggaacgcggcttggtgttgttctgctgcggcttttgctaccaagagctgatcctgcgcctcggccatgggcgccacttgagcgagctgaaacttttgctttcgctccgtgagctgtgcatatttgacgcgccggccatatcgcaacagtccaacgatcggctttcggcataggtgacagctcgcttgctttgtaggtccgtcaggtagcggctttttggacttgaaggcgatcagtccagtgttgggatcggtttcgcctgcgtagtactcgctcatctccatcatgccgtccagactcgacattgtcagggcgtggccacagggtagatgtaagatgggatcctgatcaacatcaatctcgcccaggctttcttgcaagatcatgtctaccggcatcgccatcgttttaggatccttgcactcgacgcaaaactttcccgggggacattgctcaccgcagaccgaggggcactggtgaccacaatcaaggtttcgctcacatcgcctattacagggtaatcgatcgcacggggctccgcaaggcaggttacaactcccctcgtggggacaagaccacacgcaggtctcacagcaagctgcgcaggggatatcgcattgctggtggcattggctgtgcgcacatcgcacctcgcacgttttcttgcaagcgggctttgagtttcggggctcactacaactcgcgctgtaagcgtgaccgcagatcaaggttctttcgtgcctcgtcaggcactcgccgtggataaagcgagcgacctcattagcatggggaagctcgttcatctgcctgagctttgccttgttggactgacaggagtggcatgctcggagacaggtgtgaccacagtcaagagcggcgccgcaaacgatcttgcactgaacgcgtgtcgcatcctcgtagcactccatttcgatcttgtggtcgcacagaagcaaatccttcttgaccttgactctacacacgatcttggaagggttttgcttttgatggcacttgggctcctcgtaaacatgaccgcagggcaagatgatcggggccacgatctccaagcaattaccacatgcatcaccgcagtgctttgggcaggcgtgctggcaaagggggtgcagtcgaggacagggctggaagcattttaccaactggtgcttctcgtcatcaggatggcctaagagcaatcggaaatcgggaacgaaggcatgaatacaacgatatttgaatgcgagcactttgctcatgtgtcacttaaatttctttcatcgccaaaacttacaggagagtggacatacgtgaccgcacggcatgttgcgaccgcaggcggccgtgcacccgccatttggagctactgtcctaagagcatcgggtgtctcgatgatattcctggtgttgggatggttcttacaaacgatccggaagcccttatcaatgcgcccgttgcgatccagctcctcgatgaccttgggccatattccattcttttcctgcctcatcagtccggcatttcccagaaggaacattccatgcttggctcgggagagaagcacattggctctgttgggagacttgaggaaaccgatggtgttgtaggaagacaggttggcctgcgcaccggcgttacggacaagagagataatgacaatctttgcttcctctccctatgcgaaaatgaacaaattgtggttatgaataggcataaacgggaaggcgtacagagggcatcctgaggagggtcatgttattacctgatagttgtcaatggtcctgagtgtgatgtggctattcatggacaccttcttgacgccgacggtagcatgctggttgatgttcaaaccctctctgcccccatctttggaaccggactgttctgcattgtccaactcgttttggtccaactgctcctggtctcgctcatcgatcagcagctcaaacttgttccgaaggtggtcgcgaagtcgagagagttggcccaggtacggtgtaaggatcgcaatgtccccgggcttatcgtatccattccttatgagatattgtgcaagcgcttcgaccatcttgacctcaaatgagtttgtgaaggactgcatcccatactgatccttgctgtcctcggggtgtgtgtggtccatgaagaacaggtttgagcccatgccagcgacatcagggtaagcgaggactttttcaccatcgacaagtctcggatagattgcgttcctgataaggctggagatctctggtcgcatccgccgttggatggtgagctcggacgcaggaacagcgtttctacgcgcgcgcacaagacgctcaaagagcgatcgatcgaggttgtgatattcaccattcttggagtcggacgagagatggtagcactcgatctgaggccggagttgttcgtggtcaccgatgagaatcaaatgttgagtcgatggagacaatgccgccaagatatgagactctaagacttctccagcctcctcacagataatgatgcttggggcgagggccccgaacagaccttgggacttggctgctccgttggtcgtcattcctatgacggacttggtgcggagaatctccagacggacttggtcgtatgcattcgattcccttttgctgatactctccatgctctgcagcagtttagccatcttctccatcatctgttgctgcgctgctgacctccatgaggcgatcaagcggttgcgttccttcatggacatgtaccaaacgtctgcgtcctcaagttcctccagtgctctgttggtgtcaggaatgtactccagtgtaggcggctgatacgactccaactgctcgtcgtcgaagagatcgaatctgttaccaacgaggtacttttccttccagcctttgatatctttgtttctggtcaccttgtcctgaatgtcctggcctgatgcccacctctcgtacgggttcaagcgccgcctacgcgttctgacctcggtgaatttcccctcgtcagccttggtctcgtcatcgtcctcttggtcagcgttcccgtaatcatgaccaatgttatcaaactcgaactgctcccacatgttcggattcgtgatcatgaggaaggatccgatgtactcccaagccaagtactcgctgcggagagcgccctccaacttcgtgatctcctccgcaatgaccctccgttgatcgcgcacgctatacagctcctgtcgtacctggaaccccttgttgcggttttcgttcattttcatcatgctctctaaattgtagctgtcgagtctctccgccttggaacgagagccgatgcgtgcgatacttgtgatcccttcgtccagcaaatgctcaagaaactggtccagagcgtgattggtgtagcagatgcagacaattggaccacatcccatcgcttcgcggttgtggaggagcaccctcatgagatcgacaccaattttcgttttgcctgttccaggtggtctgcatcaaataagaagcgggacgaaggtgcctgtcagcagtagtgaggagcgtgcaaagaaattcaaattttgtggtatagtgaggtcttaccctcggatcagagcaacctcacggcatagagtcgcaaccaatgcttgcgcctgcgtgtcatcgaggccactgtagctttgtagcatagtcactgccaatttcacggactcgctgctctggacgtcaagttgacatggcacgcgggctcgaaggaggatggacaaatcaaacacgaaaccaggagcccgtgtgtacatcggaggatcaatgcacatcctggccgtatcaacggcttccatctcctccttggtcggggccaagtactttccaaagggcagagtagcagggacgcagttctgaagggcttggagaatgggcctgtaggactcgaagaacgagccggtggcctcgaccagaaaccattgactggatgcaccatcgtcgcttttggcgccgccaagtgtgcgcacatactcctttggatcggccaaagagacctcgatacatgcaaatgattcgtcctggcccatggcttcggtatctcgcacagtgactactccgagaatcatctggaggttggggatgcctgtctcgtccgtagcgagttgatttgcgcgactggcaatgcaaatgagggacccttgcatcagccttcgcttggaccgctcccagaactctatgcgacgactcttgttgacccctgtcaattgagacggctgcgtaaatgaaatcttgacagatcctccagacttgtgcttgcagttcatcccaaggaaccgaacgtttccatagacgttcaggctgacgttatcatcaagacgctttttgagctccttgtgtctgagtaaaatgccctcgtcgccgttttcggttcggtggagtgcgcccaagaaagccgtgatacccttacgcagagaatccatcatgtcctcacggtaaaggcgaaaatgaatgtcaatctgtcgactccatccgtggggcaaaaagtgaggcgcctctgggatgtcattcgagggcaggtaggcacctcgctgacaaattacctcttgcaatgtaggcaggacgctgatctcagcgatatcggcataatcgttgtcgtgtcgcctacccctgggagacagttcacctggagggtcatactcgttaacgatgtgcgtcatattcacggcgcgaggcctggatggacttgcagttggcaggccagcggaagaaaccttgggctcaaggatcttgttttgtgcatcagctgtgatccttcgcagtcggtcgacctctcttgccaggatctcgctcggaaacacattctcgggggtgacctcttggagaccgatgcagaggatggtctgctcgtgtagcttgtccaccattggagccatggtagtggccgcttctttgatgcgtcggataagctggtaggccaagcgcactacagcgatcatcgcacattgcagagattccacccggcacacggaggggtcctgcaagactttcaggacagtggggttacggtccttcaaagacccgcgctctaggagctcgtccatgcatgggaggacgccttggtcaaagaacgctttgcggtgctcgtagactcttgcatagatgatgcccgtttcactcgtcatcgtagagcggcaaaccttctcccgggtgaggaccccgattaacggcaggatgacatactggaacgacaccaggtcccgggagtcgccagcatcgacatacattctctcctccatgatttcggtgagtcgagctataccagaaggcttggaaaggccagccaagatacccgttgtgtcggcactgtgatggttggacagattgaggaggcaagagttgacgaacatcctcatctggcggtgcccgttgagatgcgtgaaatcgtctcgcagcgccgtgaatgcaaagttctgcgcggtgccacctgtaatagcagctgcgacaatcacatcatcagtacactcgttcgtgatctgggtagtcgctggtctgctcgcagccgagatggcagccttgtcctcctcggagaggccccctcgacctcggccacggccgcgtgccgcgtcatagccaccgcctcgtcccctgcctcctcctcctcctcctccgcggcctcgccctgagccgctggcgttgttgaaaggaagggccatggttcactgaggttcgctttcaagtatcaaatgtcactgtgtatcaataagcattcgttctctctgatggcggtaaaggtcgcagcagagagaacatcgcaaagcaggctataccttgttggctggctggtgttctttaccttgcctttttgttagctcagattcagtgggtgcaagtgttcaggattgtgtgggtgatagtagttgctggtcgaaagaacaaagagagggatgcgacgcaaagttggactgacgagactttgaagaaaaaaggcgaagtacgcccgaagctgtagcagcttgcaactatatgagctgtatcacaggactcgctcgcatcaacacgcgctttttcatgccgacacgaagggaggaacaggaaggaaaatgtcgcaggcaaagctgcgaggaggcctgtgtatgtgtcacatctgcatggctggcaaccctactagcatgttcctttggtgtcgggtggggtttcgcctctgcttgcaggcatcgccacattcatgcagaaaaatggtcttcagtacagtgcatcttttgccgcgagcgaaaagaacgaaggcgtatttggttacacagatgtcagatctcgagtgtggatcgccttgcggtctactgtcggagcccctgaaatttcgcatcaaataaaacgctgtgctcattgaccatggagcgttaaacaataggacctactgtaaggaaccagaagggaaaaaaaccacaccatgacgataggggatacttactgtcaaggtccatctgtgtctctatcaggatcaatgatcatcgtcgattcaccccagctactaccccgaaattctgtgaagaaccaagaatgtgaagacctctagggagcctgctatggcacttgcaagactgaaaatacataaagtgcacgcatgagcgcaaggttagcgctgattgctctacttcactcaacggccatgttatccccccctgtcgtccttgtctgtcttttgatagcatcaagtctactggatgcacccgcatacgctgctccatcaacctccaagctccgctgtaaatgtttaccatcacagccttgttggcccgatgcagcgtcttggtcggccctcaaccaaactgtgggtggccggctgatagcaacccgtccagtcctgtatgagtgtcacgatccaaatttcgataatgccgcatgcggcagaatcaaatacttcaacaataacaactggagactgttgcagccgtctgcacttcaagtacctaattgggagcaagatgagggcaaaggctgcttgggcctcaataaaagcacgccatgccaccagggcgcagtaccgctgtacgctgtcaaaagtagcacagttcgggatgtgcaagaaaccatcaaattcgcaggcaaacacaatatccgccttgtagtcaaaaacactgggcacgattttctgggccgcagctccggcgcttcatccctcagtctatgggttttcaacaacaaggacatctccttcgacgacaattttgtcccgacaggcgccaatgaagacacaaacgggaccacagctattgttctgggctcgggtgtcgtttgggaggacgtttacaaagcagccgataagcataaagtcgttgtacctggaacgaccagcaccgttggagcgactggcggttactgccaaggcggtggctacagccccctctcgactacttatggtctttgtgctgataatgtgcttcagtacaaagttgtggtggctgacggttcagtcaagattgccaatgcacatcagaacatggctcttttctgggccttacgaggaggtggtggaggcacctttggcgtggtggtggaggctgtctaccgcacctttcctgccatggacggcatcaacatggctctctgggatctttcctttctagggaacaaaccaaaaagcgtgatttttaaacaatggctctcccttcaagccaacttgactgagcgtggctggtctgggacctcttttttcacggataagtcgttaaagctacaattctttcaacccaacagcaacacggatcgtctcagcatcgactacttcttaagaagcatcaattccattccaggcatctttgcctggggtagcgttgggcatttccctaccttctggagtgctttccaagcctacaacacccgcgactatcatggaattgagaatcttttggtcgcttcccgcctcctccctcgcgagaaattcgacacacccgatggaattgaggagctcacggatgtgctgttgaaagcacaagaccgtatccgcggcgagggaaatccaaaagcagagatcattatgcacacggtcgctggaggagctgttgctgacggcaacgacgatgagacatccgttcacccggcctggcgcaaggccctggccactatcggaacgttcgcaacctggaatggcgatcagcctttggaaaagcagcaagagtacagccgcaacctgacctcgactgtccagctttggcgtgatatcacgccagggtcgggtacatatttcaacgagggcgatgtcaacgaaccgaactggcaagagaatttctttggaaccaactacccgttcctcaaaaaaatcaagagaatgatcgacccccatggacttttcgtatgccgcaaatgcgttggtagcgaggactggagtgaggacttcaactgccccgtgtcagccgcatgaatctagaccaccttttgcaaaacgcgaggtaatgctgctcatccaacctttagatatatggcatcctcgctctgtttttatttggcgatcgataaagcacaaccatccgttgaagttgaataaggggcttgagacttgctccctcaatgctgataggcatgcatttgcgacttatatgtgtacaaagtaggcatcagtaggcgtagaggatgaatgctttgagagagaccttctcatttattattacgattaacaatgcatatgggtatgatgatagctaacagcttaagcggggacaccggggacctttccgcagtcgtagtacactctgctgacaccgggcttgctgcggttggttctcttgacggcgttaccatcgcatcccatgcctccaaggcctccgttgccgtcattgccaccgcagccattgcagaaccatgcttttggcgaaatatctctcggcacccataggtgctgttcaagctctctatgagccttctttagatctgagagaaggtgggtctctcatcatcaaatattatattttcttgaatgttgttcgaagaacacatcctttcatcaggatattgagcggattggtctttatccaggggttgcaatgtgcaagggtcatttttttcaatgctgcccgttaatacaatagagaagcgacgcataggaccgtatctggaaagaaggggatgcaatggggggagagggctttgaccactccgccatttccatggtcgcatgtggcggagttttcaactggccaggatgtgaacgggtcctccatgtttatcatattcatgattgaccctgtccaagcggagtactgtacgttgacaggaaaatgctcctgagaaaaatggaagcgaaattagaaatcagagttgacatcactgctgggcgttcttaatcgtctcaggtcgcacagagcaaggttgccaagaatggacaggatgaaggagtgtcccctgtcggactttttgtttgtttgtttccccagacaacaagggtcatccgcagccaagacgcagcagttatggactcgcggcaatcctcatcaaggccatcaacaagttgtataaaagacaccctccacccccgtcgtttctgctatttcctcatcacaaacaactacaaagcaatcccagccaacccaactcaagtcaagccaatactcttaggtctctttctacaccaacacatcaacaaacacaaccatgccgttcttcaagtcctcctctgcctctgccaagaaccagaccgcctctgccgctaccaccccagcccagacgcctcgctcttcgatgcaagccactcgccccaagaaggagcaggcaaccatgacagttgaccaggctctcgagatggccatgaagaaggccccctacgcctcacacgcacagtccgcattccttcccgtgctgtagaatgggatcccagtcgcgcacagccttagcatatacctttttctgcattcataaccatagcatctcacacattgtaaacttaatcaatattaaagcattcagaacttgatatcacaactaagaagcattttgagacgtgcgtttcgctgctgtagcaatatctgaagatcgcgtatcacagggaaggtcctctggcacacatgcatgttgtacaggagctcttttatcctctctttatttgattagttttcatgcggttcctccgggacgaaagtaggaggattgtaagctacgtctccagcccgtctaatcgccaatgtcttgcgactagttctcaagtcgtacctcaattagattaagcttgctaactgactcggatgtatggcgtcgtacgacgcaagttgtactgttggttgtggatagttccaagacttggcgtcaagtaacaggtatgcacgggagaatttgcagtggggggacagaatattcatgctcgagaatcatatcctgcacatttttgccatctcttatcatctttcctcctctctcgccacctacagctttctttctctcgttgataatctctccctgcactgttgccaatttctctcgttaataatctctccctgcactgttgctactacgagaaactatcaacaaccatgacggatgatgtaaggactaccagaggtagacgtctccacgatcactggagccattctcatactcgccagtaccaaagtcattaccaaggacacctcttggctccgtagtctcacagcagttggtgctccgcacatttctgatggagttttgatgagaactgtccagatcctcacgaccagcaaggcccaagttaacagcgcgtgcccccttgctaaaactgcctatgtctactacgacgacaacgacaacaacatctacgactctgttccgatcgaagtgagcactggtactgtatacgtaacccagcttatctttgacagcaagaccaaaggttactacgtttaccgacaccgggcgaagatcgattacagactggatgggccgtacgacacaatggaaactgccaaagatgcattcctaataacctatatggcgctgtttcgagattgagtggaccaagcgcgagaccttaagaagtaaatggagccatgagatggggaccttcgagccgtacgaagaagtcgaggaggttgaggagatcatcgaggagacttgtcgggcagccgctgctgggtcaccgacactgacgactgcactatcggtggagccaacgggcctggcaagttcacatggacaagttgcatctgttgccacgaccaaggttgggtgcgcttggggtcgaattgtcaaggtactgaccgctcgcaaaatctatgtcgataaggttgcttccatcggcaagacatcctacgtttactacgacgatattatcgatgactccgtcctcattgagaggccagagagattgaagaagtcgaggtcaatgatcctttcgggtcaggaaagtcgaagccgcctgctgggaggaaagaaaggtggtagcgctggactctcccctgctaccatgactgcattgatagccccgtcgcgaatgtaaaccatggttagttttcaaacgtggttcgtttgaagtgagtgggcatgtatatacatgcccggaggcacactccaaagtcagacttggcctctggatagacgaataaacacacagtgcacatggtataagcgcttctggcaagcaacagatcgtactcatgatcgccctgatggagaggcacagtacttctgatgtttagtgtcaattgatgcttttgaatattggatgctttgatgatattagatttacaatgagtgagatgctttgatgatgaatgctgatgaaggtatatgctaaggctgtgcgcgactgggatcccattctacagcacgggaaggaacgcggactgtgcgtgtgaggcgtagggggccttcttcatggccatctcgagggcctggtcaactgtcatggttgcctgctccttcttggggcgagtggcttgcatcgaagagcgaggcgtctggactggagtggtagcggcagatgcggtctggttcttggcagaggcagaggaggacttgaagaaaggcatggttgtgtttgttgatgtgttggtgttgaaagagacctgagagtattgacttgagttgggttggctgggattgctttgtagttgtttgtgatgaggaaatagcagaaatgagggggtggagggtgtcttttatacagcttgttgatggccttgatgaggattgccgcgagtagtcataaatgccgcgtcttggctgagaatgatttttgttgtctggggaatctctcgagtcaaaaagtccgccgtcgctccaccagaaatttcgacagacgtccctccatcctgtccattcagggcaaccttgtcctgtgcgacctgagaatgcccagcagtgatgtcaagcctgatttctattttcgcctctattcttctcatgagcactttctttctgccgttttaccccgccgtggaaaatatcggttctgagaatgaacaaaatggaaggcccgttcacgcactggcttgaagagtaactccgccacattctcccatggactggcccatgcattcaccattcgccatcaaacgtgcctagtgatatttgacattccgaaggaccatgcttttggcggaatatctctcgcacctataggtgctgttcaagctctctatgagccttctttagatctgagagaaggtgggtctctcatcatcaaatattatattttcttgaatgttgttcgaagaacacatcctttcatcaggatattgagcggattggtctttatccagggtttgcaatgtgcaagggtcattttttttcgatactgctcgttattgcaacgcttgggaccgtatctgtaaaggggggaatacggtgggggagagggctttgaccactccgccatttacatggtcgcttgtggcggagttttcaactggtcaggatgtgaacgggtcctccatgtttatcatattcatggttgaccctgtccaagcggagtactttaacaggaaaatgctcctgagaaaagtggaagcgaaaatagaaatcagagttgacatcaccgctgggcattcttaatcgtctcaggtcgcacagagcaaggttgccaagaatggacaggatgaaggaatgtcccctgtcggacttacttgtttgtttgttaccccagacaacgagggtcatccgcagccaagacgcagcatttatgactactcgcggcaatcctcatcaaggccatcaacaagttgtataaaagacaccccccaccccgtcgtttctgctatttcctcatcacaaacaactacaaagcaatcccagccaacccaagtcaagtcaagccagtcctctcaggtctctttcaacaccaacacatcaacaaacacagccatgcctttcttcaagtcctcctctgcctctgccaagaaccagactgcctctgccgctaccactccagcccagacgcctcgctcttcgatgcaagccactcgccccaagaaggagcaggcaaccatgacagttgaccaggctctcgagatggccatgaagaaggccccctacgcctcacacgcacagtccgcgttccttcccgtgctgtagaatgggatcccagtcgcgcacagccttagcatatacctttttctgcattcaaaaacatagcatctcacacattgtacacttaatcgatattaaagcattcagaatttgatatcgtcaactgagaagcaagatcggcatgtttgttccgttgcgaaggcgaatgtggactgaacaatctgcttgctaggaagagtgctatagctattgtaacaaattaggtgttggcgaggaaggaccctagcatcacccggacttagtcctgatctgtcctgcagttgcgatcgatgtttcggtctgccaaagccctcagtgccagaatatcgagcgctgcctgccttagactggcgcaataggggcttttcacgtctccaaggacgataccgctgtcgcagcttgcgtgattcatatcagttggccagttgatgctctcagcctcagtctgccatcgctgcgaaagactgtttatagctgcatcatagctagggtgcctggttttgagttggaaccaatctagctggtgcaaagattgatctctgtggtcttcgacctctgccatcacaaacgtcggtggggatgacggagaggactgctgttgtatcaaagacgcataagccgtatttctgggcgtctctgttctcgaacgtggtgccaggaacgaaagggtctcgaaaatgacgcgaaaatcatgtagtaccctccagagtgcgaagctgctggtctgttggaggcaaacggaaaatgagaaagatcataattttgttgtgatagcaggtggtttgaatacatgccagagtgctcaccacatcatttaaaagtccacatagggcctcaagcagcaaatccagtaatgcgtccacttctttccagccctggtcttcgccgtgcgatcggttctccttcaaatcctctgccgccctatccatcaatgcgaggatggccgccgcaagctcagggcagggctgtgtgtaagagtcgtggcgtttgaagaagtcatgtacgtctagacaacaaaagcccataagaagtagatcctccgtcgagactcggttgatatgtggtaggtgcacgtggatcttattaaggagaaggatgccattgattgcgtagcttgccctatccctcgttgttggtctcagtgagaagtctcgctcctctgcgacacttaagttcgtctcgaggcagttatcgataaggcataggattgagttccaaagagctgacgttggtgacctgtcgactgataagattgcaatagaatctgcaacgatcaaacgagaacgtgcaaaggtcttcagtcgatgtaaatcttccttctgccagcacgagagaacaatcgaatgtaaacgttctcgtgatctcataccacgtttcagttcaacgaatgtcaagaggagctggatattggccacggctcttgagaagagaagtggataagcatcgtggtgtgcgactgtctgcagcgcttcgctgtggactgaaagctgttcaaaagctaggtgatggagaagccaatctttaggttgatatgcaactcttgagcaatgctatagggcaaatatatagattacggtacctgaagtggggtcgagcgtttcgatgatctcattcgatgctgtctccacggctccctcggttctaaggggtaaaatagactgggacaactcccgtagatctcgctccgctactgaatcgtgagtttaacaatcgaagtcaactcaagatgttttcactggcattctgttaacaatgccttaccatcagtgggtagcgcttccgttgaaagtaacttaagtgtcgaaatggcaacgccgtggaagaactcttgtccagcatgggttatacaaatcggctgttctgagacgatttgagcgatagcctggattacactgcatatgatgtgaaggaggtggttgcaccgtccaagatcgatctccttggagttcatttctatctccctgcaaatgtcaacaaagacagtctatggatggaactggttataataacacctcacgcatttaccagcatgacatgggagcaagttaaattcggcacggtttttttttacctgcaaagatcgcaaagcaccagtttgagccatgatgattttagccacctgttcagtaccgtgggatcccgcgatagttgagacactctcagtgcatgccgaggacgtcttctcgagccatatcaacatcttagaaagagataacttttagccatagttgtagacttgtgaaaaatgaacagtgtaggcacattatcacgtcgcacatcagcactaaccagctttaacagaaatcccttgtggaaagcaggaatcgatacacctcccgtgcaatctgtatcccatgctaggaccaaaatatcatccaaatggctcgaaagaagagatttggcgaaccagccacgcgaaccttgaatcgagatcttcaggccaaagagaagcttgaaatgcgcaagcaatcgattttccatgacatctggagcagaggtctggatggtccgctatttgatatgcgcacgactgtaagattctcggatgcgctcttgctgtaagtattctcgtagtcaaggctgtattcagcttacgacgaaaatccacgcgagttgtatccagctgctgccataaagatggtcgaaatcctcctcgccgttgagaaactcgatcacagcttgacccacattcgctgaccacctagagtgaagcacgcggcacttgtactatgagacatccagaacagagagaatgtttctacgttcacagctccttgctatctatccctgtatccctcaccatgccagattgctgtgaagaaacttcaggtacaatagggtgataatccatctctgttgctccttgcgtgtcagacttgagtagtctccttgcctcgtcagatgaaatagtggattggcgcctatagtcactcatctaagctgtgagtaatgattttctgtgctccactctatgagatcacagatcatggctggagataaaaattgaatacattacagttcagctgcggtagcacatctgctgaaggcatcaaatctccagaaagaatcgaggtggctgcagtgtcttggcaaagaaagataccactatactctactagggtgacaatgagcgccctgcatgttgccgagctctgaggggaggctgaagtatggatcgcttgcagagcatagtcgataagtccatgctcgtctgttgatgtttttgatcagatggtcaaatcgttagcaaatgtaccatcacaccagccgcagcgcaaggttgtgcgacggacgtacatagcctattaacaagctgcttagcagctttttcgattgagtcgacgccacgttgcagcttacatatctccagcagtgccaatatgcctgtgaagagaagcacgctgtctgagtgacaccatggcgcctatagagatcgaacggtttgagttagagttgaaccacctttaaagtgctgcatcagtcgtgattcttaccaaatgctcgggcagtaagcattcgtcatagagacgcagagccatcgagaccagactctgaacgtgtggtgaaagacatggggcgagtctgtgggacaggtgcgcgtgtaggcgaacgagtatggatgctaccagctcctccactgcacagcaaagtcaaaggtgttatcatagtgctccgcctagcaccaagctttctgttttgcatttaatgagactacgaacaaacttaccctgcaaaagtacgtcgatccgacgaaatgtctctccactatcgacttgtcgacctactgagtgcaggttggtccagatcggatgcaggaggtcgactagtgtcctctcaagaataattgattcgaaatccaaggtgtagatgctagccctgtcatcgctcgatgcacggtagcatgcgctggtgatcctgtccataatgtcaagctggggtttcaaattcacgctaaagaccttggtcagtagctcaacctgatctacgttaaaaacaagggtgtgagtttggtggcgtaaccatgctctaaaggttgttcttgcaataaaatcccttcagaacttacagtgcaaggaagtaaaggtgcggttcaagaagctctgtattccttgcaggttccctttgttctcaagcatcatgatggcctcgcatatggcttggctggagggcagcagtagagcgttacccgaaatcccttgtgtcgatgatgcgttgtgcacatcctgggcctgttgctgctgttgcaaggagacaagactctcgtaggtcaggtcaaggatgaggtgcgcttgtcgaggcgagtctggcatatgtatcattgcttgtgcgtgctgaaccacggaagggcaaatgtgagcgcaagcagaaacgcgtggttgaaagaacacaagggtgaagattttaatttacggccgctgcaagtcacacaggcccatggtctgggtgccctttgtggacgaatcaacacgccaagggtcatcttcacgcaatcagaaggccatttgggccactcgcatgcgccgtccaagacccctgcgcgatggcagggtaggctgcccattcaccctcctatttttttttctcatcacctgatcgcccgcaaaagagtgcactcttgcattgctcaccaattcgattgcgtaagtggccctcacgtctgcattcgtagtagccttcacaagaaaatctatcatatgccgctgaatactgactctgacagctttgtacgggaaacagaaaatcatggatcacgggcagttgttgctatcaagcatacattggctatcatccaggtccaagaagcctggggataaaataaaggcgggcgcgatttaggtaaagccacgctatactccgcacgggctctgcactagcacgctatgcaaacacgttacatcgagcagcaaactgaaaactgttggcatgaccatcagtatctgataggcgctgcttgagagcaaatctcaagccgacttcatgtcattggagaccggatgaaccgtcgctgcagaaggccagcttgaccgatgagccgccagcactcacggaaggtgctttactgggaaggatacatcaaaacgactgcatcagcatatggcacttcggaataacacaaaaacatcttcttaagaaagcaggatccaatcccccttctgccttaagaggccgaccgcaagggatcggaataggctagaaaacaccaacgtgagcgacgttactctgccatagatccatggaagagatacttcctactacattacccagcatcttattttcataaacctagctccattagcactgattagtacagtgtctgagcacgcctcttcctgttctgtaccttacgatcaccaccaaacgagctctcgaggtcgcggaaggcacttcaaggttaatctttacgccaaggtcaattttgcctgctttcatgtttgatgaaaatgtacgagatgtttcctacgtgagaagtgctatgaatatggtgtaactgttggcggtgaaggtggtacatggaggagctatgtcagcacggtgagtgagtgccgtatagggtccctagcaggcggctgcgttacttggagtgtcgggcatacagcggagactcatcgcagccttcagtccctacgtgtatagctcagtcaaagtcgaaagttagtatggtgcagatgatatataataaaacaaaacgctatcgccagtgaaagtcttccgatggccagaaatgcattgaagtaagtcgcatacgcctctgctcttgggcaacatcatcaccccacatcctccaatggtcaaccaggatagatgtgaggatgactgactgagtaaacaaccctcacgcaccacgcatagattgtgagaagctgacaaacgacccaggctccaagggacagagactagcagcttaagactcgtccgggctgcacagtccttactacacccacttatcaacacgaccaaatatgccatgaagtggatgctgtcgcaatgcattcctgttaagagaatagccaaagtaagtcgcatacgcctctgctcttgggcaacatcatcaccccacatcgtctaatggtcaaccaggagagacgtgaagatgactgactgagtaaacaactctcacgcaccacgcatagattgtgagaagctgacaaacgacccaggctccaagggacaaagactagcagcttaagactcgtcctggctgcacaatccttactacacccactcatgaacacgaccaagtatgccatggagcgggtgttgtcatgactttctcagaccatgcgagacacaactaacgagggtgtacacaacagggcaacaaacttggaagttgtccttgagcttgagaaacagggttcgacgatggaggaagggagcgatggagacaaacgcgatttctttcgcatgagtgcgtacagtctgggaaatatcattttttcaacgtcacctgatcggaagtggtgttcctgaggccgttccttgaagatgcattcatcaagctttactggccatgtgtcacttgtcagggccatagctgacttcactgccaaggtcaacccttgacatcttctcccattccttccttccaggacacccttaactcttaaaacttgacagggagaagagcgaaactttaagcgagccacgacgctcagcgctaaaaacacgagccactttgacacataaggtttccttcacaacccacacgcctcacgcacatcctactctccattcacaacacacacgctgaaggtctcaatgaatagcaagaaggaggccaacttcatggcgttcttgaatgaaacggccgtcgaagaccaggaccccgtgacgttctttgaatgggcaggctatccttcttgcagagagggacatgctgctgcggtgtggaaaacatcagttcgcggccttgataaagaaaaggcaatcatgttggaaacaaagtgggcagattccaaagacaggagaaaggaatattgggagaagctgcgccaggccgagcttacacaggcggaagcggccagaaagatggtacagttttttatgtatttctcagatattttcaaaagcatacgctgtagggtcgttctgacgattcccttgccttcattaggaggaatggtcccagagactcgggaagctcaacgaaatggaaaaggatgttgtagctgagttccagcacaaccggttcttgaagtttatggatgataagacctcgccatttgttgtcaagcatgagccttctccgccgtgctcgcctctattccctaacaagcgtccgcgcgaagcctttgcaggaggcagtgaatcgtcctgggaagttctgacgcctggcgacattattgatgcactacaagatatgctgcctcatcagcggatgggagagattctaggtgtcgcgcaaggccatgtattttcctgtgtattggaagatgacaacgtgggcgcacacttcactcaatacttcaatggctgcttcctcgagtcttataagcatctgtacccggaagatgcgctgtaagttcctgtaattattcgtgtcggaaatcagcgagcttgtatctaaactacaatttgatgaaattttctagtgcgctatctgcaaccctgctgatcaaaaagaactctcgctcccctcgactaaacaaggcatttggtgtccaacgattaacagccttgagagaatcgctcctgaaatcgattgtccctactctggatgccactctgttagacaagcaacaggcactgatatccaagtgggttgggtggatcggcttggtttctgaaaataggagagaaaactcgatcaagcgaaatcatatactggaccggctacacagcgactggagtgcggcgaaggaccttaacctcgcagaactgcacacctattttttactgtgcgttcagggactttctgcaacacagccattggacttccaagaagttgacggcatcgcctcattcatacaaaacctgctggcggctgttttgcaggaagtggatttggtcaggttttcctggtaagagatgagattggctccgtttatgcctctgataagctctcgctcatgcatatctggcattctaaacgtagcgcggataaatgttccgaggcttcgcgatacaacaaggccatcaaccagctgcaaggccaatcaaagcagcccgatatggttggcatgttcacccatgagggggtgaagctcgagaccttcttcggcgaggccagcagtgttactgcaaggagcccatcgaagtatggtggtgacactgtcaggttgggggtctttggcaagaacagccacgacatgatagacaacctcgtggatgtgacgacctcgttgctgcttttcaacatcaatggacttgtcctgcaggcttttgttcttgaaagatgtcaggacgtctacatgatgctagagatcggaacaggccgaatcccttcttccgtcaatgatttgctgttcttgtcgcaggatttgccattctggctacagctcagagagcttgcccgaaagacatccgcgtgtatcgagcatgcagtagacgctggtcaagtggatcatggacgcaggaagtcctttttccctactattacaacaccatcagcaagaaatgccctccgcaccaagtagagcaacagcatgttatcgttcgacaagaactcactcatagtttacatttcttgataatgatgctgagtatgaacggccggaaaatgtagcacaaattgcacaataactatcagccgtatgccaggcttgaagtgctataccttcagctgtatttttccaggtacttcacgacaggatcagctaaagtagtctggacaaccattgggaccccttgacgatcccgaaacgccaaacgagatgctgttgacccactgcgcattggacgccttcttgttggatccgagtgtagcgaaatttccagtacaatcgcttcccgagaacagcttgatcgttccgccgttgataccctgaatgctcgctgtttgcgtgttcctgaggcaaaagcaccatcgctcggtcgagggcacacctagggcagtcttcctgccactgttgtttgtgagctcaaccgtatggccgattcctgcgaacacaacctgcagacagagtgccgacaagagagtgattgtgcaatacataattgggggattgagaatggagtacatccaagttgagaggagagtgacaccatttataggcacatgcacacgtgctgcgggagtctcgactcgtttcgtgaacaacagctgcttcgagtctctgcgatgaagctgttatacaactaaggcggcgtcccattgtttgctaacaataatgcaaacccatcgcgttgatggtgctcggaaagcgataagccattgaccaaaacatgaaaaaaaaacgcgcgtcgggagggactcactagaaatatcgctgcatttaaggtttgaagacaggaacttccgatgtttggtaatctcgcgatacccgacctcgtgacttcttacatgttcttgcaaaactcggtggactaaatacataacgtcagaaaaaagaatgacggaaaagaatgcctctttatttgaagtatttaccgaggggaaacatagtagttggggcagtgaccacctggaccagcggaggagatgtctggctcgccatacgaaaaactgttcacccactgggtgttggtaactttttggctgggatcaacagtctggaaggagccggtgcagtcgctcgaggagaatatcttgatattacctccattcttcccttcaatggagcctgtctgcgtgttcctgacgcagatgcagtatctgtagttgtcattagctttgaacgtgaaggcctgggagccactagtgttcttgatctcgacaacatagagagcgaatgcgacttgtgcacaaagtgccgagagaaggatagctgacttgaacattgctgacttgatttctgacgtgaggatgagttgtttgtagtgctgctaagaagagaagagtgccgcctttataacagcgacgctctgcagcggttgttcaaaaagcgccgcccatgcccaaccttaaagacatcagggtaataggctgctgagaaacagtcggcagctgccgcacacaaattctatgatcgacaggagacatgaacgctttcacgtccatggaaaagtccgcatgttcgatcaacacttctttttttctccgcgcctgtgcgaccaaccgaactttaggttgcccttatcgatgcgcggcgccgttgcgggagaacggcgagaaatgcagggtctggactaacgatcagcgaagacccaatgatctgtactaggctgagcaagaactgcaaagcgttgtcgagtaacgctccacatcactatcgccacaagaggttcagaagcgctcaaccaacgcgatagcatgcagttttaggatcacagatgtcaatgtggcaatggctacaaagcaaagtaaattgtagtaagcatccaaaggcacgtacaggcttttatcattgttcatggcgctttatttttgagctatctccttgtcagcgttgacgcgtgcagagctctcgtagcctcgcgtccaacgtcataaaagcatggccgtctggagtatctcccctccccatcaccttcataatgcaccaccgtataatcaacctcgcctttacatttactcccattgacatgcaggtagcagtgccctttcttgacgcaaccctccacggtccatgtacaggactgattgtgtgctagaagccgagaccccgtctgccgcgtatcatcttgtccaatgaaatactcgaccgacagctgtaccgggacctgtagatggttccaggccactaggtcacacttgttgtcgtcctgccagaccagaaaaagggtcgccacagggacatagagctgctcagattttgaccaaagaaacagcttcttgacacgactgaatttctgaaaggctggaaccacttgtgggaaccgagagggccgtggcggcagatgtcttgagggtgactttggaatgttcatttggagtgtgttactgaaggcggttgttcgattttgtcggttctttgtctggagttggcaaacaaaaatgacactcgctggatgcaagaggcttgaaatagctgccttctggcttgtatgtcactccaaatggctgcggcagttgtaatgctggtgagatgtgtgaatggactgtctttaagcgtttcgcggtcgactgcgccgtcatgcttgccgcccctcccacgctcctattcaagccgagtacaaattacaaatcttcagcatcaacgacagttccccctaggcacgtcagtcataaaagatgtattggtatagtgagccgaaagacttttgacgacctccagctcatgaataaaggaaaggttcgtactctatcgctcccttgccccttgctgtggattccctcgcggacccgaaggctttggtgggtctctctgactggaaacaccgccctgcccagaaccattgatgtcatcctggttcgacacccccgcgtgcatagagttcacacgacttggcgctgccgaattgtggaccgagttgaacgcgctcgaactcacactcatagctgaaatcggtatagagggccctggcgatggagagggcggtattggctgatatggatgggctgcatagataggagacgatggtgtcgaggtgggcaaatgatggtagcccatggaggacgaagatgatgggagttcggccgcggcactcacagctggggtcttgctatcatttgggtagatgtatccaacagctctgtaaggatctgatgggccaggagagacaggggcaaatgcaaccggcacttgctgtccaaatgcagaaaggggtcgcccctgctgttgcctttgctgcatctgctgcatctgctgttgctcttcttgttgctgctgttgcagttgaaggagcctccggtgcagctccaattcctcctgttgattctccagctgcacgcgcagatgctggagctcatcattcctgccggtcccttgtgattcttccatctctctagtctcgacaagttttgcgcctcgaggccggccgttacctcgtttacggcggaggaagacaaaaagaagagtagcgagaatcacggccaaacctccgaccacacctcctgcaatggctgcaacattcgatccagatgacgtctgcccgtcggcacctcgttcgcctccaccagcgccttctcccgcatgtgggggtggtgttttcgcagagtcaaggtaggatgctggtggagagtagctcgagccccaggtgttgagatccaagttgtaaacgtgcactttagagtccactcgattcttcgtctcaccaagtcccccccagaggaggagttggtttccagcgacagtgcaggccgcgtagactcttgtcggtcctgggatgccctggcgccatgtctgggtcacggtgtcgagaacatagaggtcgttaagaaatcccatgtttgcagagagacgcccaccgtagatcacaatcttggtgccatcgtcgtctatgaaacggatgggtcgtggttaggtcgtgcaaaggcgtagagccaaaagttcggcaactcaaccgcaacattcccccccattaatggcattccaattcttacttgcggccatgcaatggtctgctctcgtcggtggcggtgctccgcttgtgatctgctctcgcatcatcacgaaaaaaaaacgagtaggtgagttcactttctccccttagacctcgcacatcaagggcgcgcaatgcctatttcgctctgcaactctccgttattttttttcccttaccattgtgctccacgcgttcgtttccggcctgtattccgtcaccacattctcaggcacgatgtgcagcattgagtcgtatcctccaaagtaaaggatactattccggtacttgcaccaggcgtttccatagtacgcccgtgcttggaacagtccatctgcagtgggcaatccccctgacaaggagcccaacgtatccgtcgcaaagttgtagacactcatcgtgtccctgaggcccgtgtaaccagcagccaggaagaccagccccgtgttcgggtctgtaaccgcgctaacgccctgaaagttggtcgccggccgacaagtcgcagaggtccaggtgttggtgtcgacgctataccgcattgcaaacagggccccagagtggaaggtgatcaaagtcttgccgtcggcggagaaggcggcaggaaagagttcctgttttgggccgtcggcgagtcgcgtccatgcaggctgagtttcgttccagggcacagccagatcaagagaataaaactggcttaggaggctgtttgtgtagttccctccggcgacatagagcttcgttgccgttcttgctactgctggtgctgagacagacagcggagattgtggaacctgagcagaggcgaggtatgaggacggaggtgtgaagagaacgggggcgacgagtagagaaagcagaaagacaaggagtgaggctgagtgtgcacgccctcgttttgagggaagctgcgtgaagtggcccatggggtgtggtctcgtgtcgggatcgggtaatcagggaatcaggcaatgggggagcagggatgggcagagagcaacggtcagaagtcaggcatggagaatgagcaagagacgcggaggtgaggaaagagggaggagggaggaggaaggagagcgaagggtggagtgtgaaaggcaaggagcacaaagcccttgcaaacgaggggtgtgcgaaacgggcagccagacggggattgaaaggcgatcgggcgtcggtgcctgaaccagccagccctggggaatcttgcgtgcatggcccgcggtcctctcgctcttcactctccagccagacatggatacagagcatagcatacgcgggtatggtacagagacaacactaaacaggggctgagagaagagagaaggagagtttgtgctttacacaacgagggggctgcttgcaacatgtatcttttccagccatgcggcagaagcatccactgcagtcagtcgagaagcaaaaatcgactgcacagacggggctgaaggaaaaaaaaaaaaaaaacattttatttgtttctggtgctctcataaagttcgctgggcctgcatcgcccaggatcattttgacgcaagcccgcaaacccaatcgcagtctgaaaataagaacttcgatgaggatgacggggatgaggaagaagtggtgtagtcgaggtatagagccacaccgctgcagatgcttgtgctgtcgtagccgaggcaggaaggcacaatcagtgactatttacgcacatttttgtgtcccacattcagtcctggtcgcaatgccctcttcaagattctcacgcctcgccctgtgatctctcggcaaaatgcagtccgagagctgagccctgcggcccctcgacatgaagaccgacgcgttttattcggcgtgtttattcaacgacgcccattcaagcactcacagcccctctagatgcctgctgctcctcgccgtaccgcctcgagggcttcaaaggaagcacatgtcctgtacctcgagtctgaaccggaggcaaaaatgcggcctgcggtcggtactcagccttctgctcgaagctgcgctgctgcacccattcaggaatgtagttcagcaaaatgtgccggaacaacctctcgagtaagttctacatagcaaccgttcaagattagcaagcatgaaaaaaaaaaccttgaatacagtgattttccagccaacgaaggcgtgctaaatgtaaagtcttgctgtattcacctgaccacccatcgcgcgagacatcaactggctgttctccagcatagccttcgcatgatggaatcgctggtcataatagtcttggaatgcagcggtgatgcctttgggtgtgacatctacgaggtcatagaggcagttggctaagatcacggcatcttgcatcgcattgaccgcgcctgaaaatgaaggatcctttggttaagaaatcgcgcgtgcttcaagcggagagtcaatacacacatcagacgcgctctgcacgcgtgttcattcacgcaccttggccgcctcccggtagcatctgtggagttgaaagtagatcaaggaaaacaagttgatcatgcgttctagaatcactgtgttatgtcgtaaacatgcaagcaaaaaaaaactctttaccttatggcacgctatttgagcggaagcataaaagtcgagatcagagtcaactctctgtactttggagcgatgtcatttgcaataagggcttaccgtctccaatgagcactgtacgaccgtagaaccacgtcttgaacattttctcttcaacaaacactttcgagaccaactcctttggtgtggcgtcgatcaggtcgcccatcaccccgccgtaaggacaaggcaggtcataaaattgtttgatcatggtctcgttcgcctctggtccccattcagagttgcggaacagctgttccttggactctgccacattcttgaactggtagatcagtgcccagcagatttgatttcccgggacattattgacgctccactttttttttgtgatgaataaatagtcaatgggttaggcaaggattcgtaaagctgcaagcccaagaaacacaggttccggacttacgatctgacggtttcccccaacggccgaggaaagataggcgtgtggctccttcagctgtggatatttgtccacgtcctcgggttctgcaacgccgaccatgcaggtgtacccgatggcgaggtcctcaaggtccgacttgggcagtatcccatgctcgttcagatacttgtacaaactctgtcgaacaccgctataagcgccatctgccccaacaagaatatcaccccggtagctggagccgtctgcacaatgaaccaacatatggtcctctttttcctccgcgcggagaattcgtttgcccatggtgattttctctggagggatctgcttcagcatcagctcatgcagctttggacgggcaaagatccgactttcgtaccctgttctattgtcaaaaaataatattcgggtcgatgttgttaacaattctggttgaaactgcttgcatcctttttttttttctgctcaagatcaatagcgcgacttacatgtctttctcacacttcatgtggactgatcccagcttctgcaaattcctgtcatagaggtcatggcttggacatggcaaagagaatttttcgagctcctccagcaacccgagttgttcaaagaccggtaagatattggcactcagggacatcaccgcacctacatttttgaagatgatttgtgtcgagcatccacgcaaaagcgtaagtgcatttttttgagtaccaaaaaaaaaagcatcacattcttttagttaccgagaggcttgaccttggccgcgcgctcaaagatatggtacgggacattgatgcgttccaagagtgctccaagcatcaggcctccaagtcctgcacccgatatgaggaccgttggcattctcttggggtcagtagactcggttgacatggcgtggtcgtgaattaggttgctattttctgttgcgcgaatggaaacggcgaggggagaaacgaggtgagatgaaggcagaattcagagcgttgattactcattgaatctcatcttcgtattccatccccacacccacctccgccttcgtccggtcccatctcacgcccatttttttttttccacttttgtacgcccttctttgcggaaatcatggacacaatcatgttcgtgacacataaaaaaaaaatcatgccagagagacaatgagaatcagagaacaagtgcaccgctgttctcaaagtgcagaccgtttgtccttcagctgatactaaagttcactccgggtatgagacgttctctgttcttgaatagcggccagatctcgcgtcctcgatgtggacggtgtctgcagcaaagggtaagggcaaaagggaagtggtttgttcgttttagggtggcactccatggtctccaacgagtcgcgggtcggttctgccgccaataaagacttgtaggcgcggtgctttgtaggagtcttgcttcgagaggcgacaaggcttggacttattcccgagcacagttcgaaccggcttcggtgagggggttcagttgttgctggccaaagataacctgatcgatggttgcagtagtcttggagtcgatctgtcattagggaggggtgggttctgcggttcaaggtcaatggttcagagtggggttcaatgggtcaaaggagtggttctcttcgaagaatgcttcaacaacgatatttggtttgggatcaaaaaagattctgatactgtccgcacatgattgcactccaggtatcgctgatcgttgccgcatacaggatttacacttccactagactgaccaatcgcgacatgtcaaagttcccacacttgacctgaaccatttgaatacactgctccaaattagtgttcacatgttttgcaaagcacaccttcttccttgcttcctcgcctccaatcccttgaaccgccaccagataccgatgggggtaagctcaatcttttctttgtcgtcctatgaaagttcgaggcatattgcactggagtgagggcagcaaacgtggactcaaagatgaccacctcatttgaacacttattcgaaaaatcctgtgttttcgcgttgggcatggcgatcctgcctttacactcaagtaattagtcccacacttctacatattctaggaggctcctgattaattgccaggcagcagccattgagcgtgaaccattgcagttttagaatgtttactaaaccccatcgttacatggattttgcacccaatgacacttcttttgagactcgaagttgatagacagctccttgcaggatttcgagggtggattcacgttgcgagaatatactgacctctggcatggatggttcgagggcaacagatcttcaaggaaagcattatgcaaaaagaacacgaggtattaatgagctcattatggaaattgcaatcgaggcggattcctcctgcggatagtgctggattcttacagaagcgatagggaggaagcgttgcaatgctgtcattgtaactttgcctttggactctcaaaatataaagtatgtcggctgcagcatacaaatgaagcgccaatgcgtgctattcacatgcgaaaacaggtccaacaaacctggcaagtttgtacctgctgtaaatatcctactaaactgctgatgactgaagctgggccctagatcgtactggatgcggatagcagctagggatgcctcgacaactccaggaggaggccttgtgaggccgagtaaatgttctctgactttgtggcgaattgctgtgaggtctgaccctttccccttcttcagctttggggcaacctcctttcgaattgttgtcgctattgcctcgagactattgtgccatatcaaaagagcggactgggttagcgcttttgtaattctggcgtagatgcgagacactgacagtggcatgcaccgacgagctcttaccaagctcttctgaaggcttttagacaagcttcctcggtaacttcgctgaggtcctgacgctcgggtgcttttcgagacctctttcgagttctagaagtcgctagtgggacttgactcggcggtgaaggcaggctctgtggggatgggcgcgtggatgcagtcgggacgaaatgcgacgatggtacgaggactgaatattcgcttgtaccccgaatgaatccacgcggtggaagtgggagactggatatctggaggatcccttgttgtaaaccacaggacggtcccgcgaggagaagagaaagatgctgagattttcggcatgggccagatgccacataatgagctttgaccgggcggtgatcgtgagggttcgctgactttgcacaggctcaagggacagtttgaaggagacgctgttgtgggtgtttgtttgcaaggagaaattgagaagaattgtgcaaacgtaatgtgcaaggggtgcttgtgaggacgaggaagacgaatagtcgagggcaacaaccccagctctgcgagacggtacagcgctctgtgtgtgttttctttggcatccgtcagtgcgggattatcggctgctgcacagaggcggcgatgaaagtctgtgtcgggaggacgatccttaggcatcatggcgagccagtcttcgtcgggcagcacagttacaatcatgatgaaagagcttcgagggagaggacgacgtagactctgtggagggagagaaggacacgcagttcaaagacggtggggcagagaaaaggcgcgttgcaaaggcgcgttgcaaaggccaaacaaaaagagactacatgctgatcttttttgaaagttcgtgacggatgagtcgctctgttggagactaacgcgtatactgcggcagtgatgaaggtgatatacccgaggccctcaccttcatcactgctgcagtatattgcatcactagatgacgcctgaccatatggatggatccttcatcgatgccgtagtttatgcactcgttaagaggcctcctcacaaacctcttgcacctcaactacgtcaaatattaatattatattatatcagacctgctttgccccaaccagaacagctagcagcatggctgattaagccctcgagctggctccgcaccgagtacgtcctagaagtcaaagtctaagtggccaggactcgccgagccagaagagctcgctccttccgccaccaaagactctgcccaagacgtgcctcgcgcgtcataccatactgtgcaccggagatgcaggcacatcagtttagtgcagtttcaagggtcatgcgaagagcggatgaccaagctcaggcaagagcaccgactgtacactgtggttgccgtaaagtagttagatagcttagttagtcgtcacgatacagccaccaggggaccggttccgctgcagcggtcaccagggagtacagcactatcaaaacctgggtgcattcacagtgctatccttagtggcaccctgatgaccactctgaatatcatcttagtgaaggtgtttataataggaactgaatgcaaacttaaaacagggcccaaggatcctcatcggatattgtttaagaggggaaatatcagataaccataggtcccaacaaaagaatgacaggaagagaaagggctgtgcacgcaacgcacaaggaatatacaaaatggggaccggtcgattgaatcagcttgaaggagttatcagtttacagggtatcaccttagaggggttcgactgtacctcaaaatagtagcgacctatgtgatccaacgacgaagtcgcaacctaaagtatacgatcactattgatccccagatgtcaatctgcttgtgcaaattcaccaaagtccagtagtaggtataataagcagagatacaaaatgcgtcttctatcttagacaccttaacgaaggacaaagtgttccaatcaaagcaaggaaagcacttgtctagacaatacgaagtgtcacagctagagcctcggctccaggtatcaaccgtccgtgcaacagtatatagatccgttacgctacgctgtatgactttactgtagtagtaatatagcggcttcgcctaagacttcaattcgtttcttttgatccagtttttgatcgagcaccagaaggctccaagtgcctctctttgtcaggattaaattgatagttcctttttagattcattttatcagaaggtggtggacagggtcgtgcgatcttatggtgcagggcggctggaaccttgatcgggggagatacacccaatggtgtataaaatttgcaatatccgaagaagatgtgaggttgctatcagggtgctcaataaccgggagggactcgtggcaaaaagaaacacatctaaatcaatattttcttgcttcaagagcaattcagggacccactgagtaactgaagcgaactgctgatccctacgggagggaataaatgggctgctgacatcccagcggtggaacaagatatagaaaccaggaacacaggggatgtgatggatcgatggaaaggaggtggattgcctgactggcaaagtcgactaggtcaaagtagtggtctcaagattacggtgcttcagcggccgagcaacagtgaaatttacgctgcagtttcgtgctgaaaggcttgcatcgggcttttttgaagagtttgagtgcgtatattaatggagcctagtggtccgatgagatccatgctcttctgtagaatttatttaaactggtttagggctctgaaccagaacaccgtccttgctaaagtcgcccgtcgtcgttgtttctgccaagtccagatgcgacggctgttccagtgccaaccgcagctcccctggtcgagcggacgatgcaccgccttgctcctgtccagccccgggtccagcgcctgccatgctgactgtcgtgtaagcgtgtgagctgtctgcagtgccatgccgtgagtgctgaacgacctcaatgtcatcctcctcgtcatcgtcatcgtcgtcatcatcatcgtcgtggtgatcaatgcttccccgccggcgactccacatcccgccagtttcatatccaaaacgcgggttttcgtccgcgtccagaacatcatcgtcagggtcgccaaaaatcatattgaagaacgctcctgcagttcctcgtcgcgtgttggccttgtgagatgaagccgtaccgtgatgaccactcgaagctcctccagacccggatcctgctccggccagatagcctccactaccgcctgcaccaatcggggctccatggcctggaccatggtggatgctgttgccctgtccatgactgatcgtgtgacgatgggtcaggggtccagaaaacatggttgatcgaacagtcaaaggcgtttgtgtcgaagaaactgttcccgtggcagagccgtgcacaaacgacactctgggactttggttggcggaggacgttccttggccgggtgagacgcccatgttgcttcgatgaccgtgattattgtaaggcgcccctctcatgcctgtgggggaatgtggatggtgatgcgatcgaacactcaggaatggtgacgatataggctgtggtgacgttggcgcagtgctattgacgctaccaggtatctctccaggagccaagggcgctgggggcatggacgcactgcgtctgtatcgagtattaaatccaggaaagccctcaaggcgctcttcgccagagagggcgttgggcgagagctgctggttgttgactggtcgaggggaggacggtgtgaatctcatgcttgacatggacgtcgaatgcgtcatgtttgcagactttggcgaagtagtcgaaagtcgaggcgagcctgctacagcatcataatcactaacaaccacatgctgtcctccttgctccccgtgtcgagaccttgcgctgctgatggagggtgcctggatataggttccagtcccgaccggagatcctgcagtgctatgaacggccttgcgatgatcgcctgcttggaacgacttttgcttttcgtcaaacctctcccattgtgatccagaccccggtgccgcggtattgggtggtgaatccgaaaggcagccttgccagttggatggtgatggaagtgcagcggcgccatggtcaaaattggagccaaccgtgccccttcgttgaggatgttgctgataatgatcgatgctctgctgccttggactatgactgtggtagagatcctccttatcctccaccctgaactccaacttgcccattgtcgaagagctgttcaatacaaagtcaatctcgaccgtgtcatccaggtcccagtgctcataaaggggattcctgggaagccacagcttacggttgagaggtttcagcagggctggatgaatgtaggtctcaaagtctgacgtccgatcctgatatgatatctttgaggacgaatgttcaaaatgagaggcgagcggacggcaatccattccagagttccgcataccatagttttcgaggtagaaaccgtgctcatccaagaaccccgcgggaaactgtgcttctgactcagccttcacctcctgaccttgttcctctgtgctagtttcctgctttgcgttgtcgccgactgtgaagagagtaatctctttggtggagctcctctttgagggcgagggcgagctcaagcaagtcgatgtcgtaggatcattcacatctttggtgtgaattctgagcgccaatgagtttctggaatgattgctcttggtctccttgagatcctcgagacctcctgagatgttggagatgccctgtgccgatgtagtcgcctctaactcatggccttgtccaaaggcacctgccttgatggagctatcaccattgtgagtcgactgagcatgatcggcgtcctcctccttgtcggtctcaagtttctcgtacttgtctgactgcgaagattttcgcaaattcctgaatggtcctgcgtactctcccgagtctttggctgcagtcgacttggcgtcggctacgtggtctgtagccacatgatgatcgtggtaatgctctccatcgtccggcaattcgagtgtttcatgccgtatcccaccaaccgagtccatgaaggcgcttgagtgaccaaaggcaccctcggatggtgcggggatttcgttcatggcacaggacgagtcgtcgtcaaagttccgcagtcctgtatccaaaggtaagaactttgtccgggacttgaaaagattgccgcacaggatcttgaaatacactgtaaggccaatcaagaccacgacgacaaatccaccgacgagcgcatgcttgagccagaggacgccgaccattgtgaactgaaagataatcaggccatctgtagtgtactggaagacgtggcgaaagaacttgccgctgttctcgtacttgcggatataacagtatgcgagttggtacttgaagaccagcaatgcaaaggcgaaaaagggtaccgctgcaacgaggataaggggattgatgaccgagtagatgatggtgatgacaatggcgagaatgttttgagggtaataatagtagtactgaaaacaccacggcaccgttgccctctgcagcgacctgggtgttggggtgaatttccgtgcagtgacgaagccatggattacaagctgagcccaaacttggacaagctccaatgcgtgggtgcaggtattgaagacgatataaaagacaaagaatgtcgctcctgagggcaatgtctcggccaacatagtgaagatgttggttggaacctgaatcagcgtaattattgatttgagaatggcggttccgatcatgaagacaaatagaacgttgaaaatcaggaagtggtagtagcgacggaagacgtttccctccaatgccgagtaggacactggcaattcctgctttgatatttctacatcaatcgacagagaatagagatcatactgtgagttttcttgtggactttgcttaaataaaaggatacccgcttggctcgttttcttaccaacaataataacaggcgccagtcccaggaaaatattgacaaagacaatgggcagcacattttgcagcagtgaaagcatgaatggtgaagcatccaaaaccggcttcaagaattgaaacttttccgaaagtgcgaccacggacgtaagaagcaagaaggatgatgttgggaagatccagaatataatgagcaccctaaattgatattgatggagcagcgttagcaatcgctttcgtaatgatatcttcatccatgttgattctgagaaaactttttctcgcgaggacaagctcagtgccttctacgtccagctcctcatgcgcaatccgctccgattgccactcaccaaatgctcaggtttacaatgatggtgcgtgaaagctgattccgaaagctggctgtcaaattgctccaaagaacatctcgtggctccatcgcttgccggaccctcagaccctgaggccgagaatcgatcttggcctgcgcacacaactgcgcagagaggtggtgcctgaaggtcacgaatccataagaggtcgatttgtagcgcagggaaccgtcccgcaactcgccgaccttacgatccagtttgttgtacttcctgacgagatagtcgattgacaagacgcggtcgccgcccttgaatcgcttcactgtccgcatgggctggtatttatccaaggaccggcgatccaatgcggccaacatattccagattgtgacaatcccgggttgatttaaagacatgtgggatcccttcggctccaggcgatgcgaatccgactctgcctccccgtggacataaacgtcgatgatgtccgagtgctgcgaaagagcagagagtggaatattgagctgaggttgagcggctgtagattgggcatgtgctatccgcttgcgggcaaagatggatttgcggatcttgctaaatagtttcttgtcctgatacatttcctgcgtgacattgcccaatgtcgaaaagtcgatggtctgcagggccacggaattgcggctgggggcagaagccgcatgcaggagcgggtgctgggtagtgggaatgacaggcgagctgacgagaaatttgtcgtgcttgatactgtcgagcacctcgcgcgcgagctcgatatgggccttttccagcatgttgagcgcgctctccctcctgtcgatcttctggctgagtcgcccacagtgctgcacaacggtcgcagactcgacgggacccattttgagtgattcaaagtactgtttcagagccgcatctgaccgcaggttcgagggcaatctactgacaaagatagatcgctcagcaatttcgccctgacggatccgctggagtgtgtattcccgtcgaaggtccatccactgccagtagttcttgaagagcaaaaacatccagctcactgttacgacgtatgtgagcaacacatgggcccaaaggaggttggagtcgtcctggatgttcaggatgctgaatctcggcacctccacaaagtgcttgtctccaaagtagtggatcgggagcaggatggtgccgacgatgatggcgttgaatatgcaaaactgaaggcacatcttgaggaaacgcaaaaacatgacggcatccagaccgacgttggcgatatagaactcctcgggcaatgtgatggtgggcttgatccagcccagaaatttcattgacatgggcggcgtcggattgctggatagtgcggtcaaacaagttatcgggtccacgagggatcgagcagaaaaagcgttagtgcgatgtgagattttccatgcaatgcgcacagtctcacagatcgagtgagcagtacacaggtcaggcacacaccgaacgataaggagatgcaacaaacaaacacaaaaaaaaatcggaaaaaaaggagacaacggaatgcagcggtcaaccgatgaccagtaaacacttacactttgagacggcagcgtggcgaatataggtactgaagcgtctttttgcgccggttccactcaaagacaccgatgcagaccacgctgacgccagcactgaggccaatctgggccatcaggccgttgtatgttgggaccagatagcgggtggagtagtcggacatggcgagcgttaggtaggcctgctagtggccgagttccctgggaggaggttgagggagcggcctgcgccggtggatgcgatcgggcctgcgagagccagcagggcaaggacggtgaatggaggagcggcgagtggaagagggggtgcgtttatatgcgacttgtcaaggtgaaagaggcaaagagagagcgtgcaagcgcaagagcgagagaatgagagacggaagggtagtaaggacagacagggaagaaacaggcagtgtcagcgccagggagaagggctgtgtcggctgctctacgccgcacagagcagatcacgatcaagagcaggagggaagcgggaccgggagtgtgtttgtgtgtgtgatagaggagactgataaaggagtgagtggagaagggcaggatggggtgagtgatgctctctctcgctcgctcgctcgtgcaatgcgagtgtgctggagggtgtgggccaagggctgaatgacgctatcaagggcggaattgggatgctggaatggaccagaaaaaaacaagcagcgagcgggagacgagtgattaagagtgtgatgaagagagtgcacgagagagtggacaagagagtgtggattgcaaagagtgattgcaaggagaaggacagagagacaagcaaacgagatgatcagaggtgtgacaaacagggatggaggcgtgcagaacgagcagcagtggacgaatagggaccacgaaagggtaacaggagcgagttggtggcactgacgctggggtcggctgctgcaggctgggcaacggtccatcctgactggaccactgcacacctgtacaaacacgcagctgctgcaagcagcatgagcaagtggcccttcccgcacacacaggtgcggacaggtggggtatgaaggtcgctcgctgaatctccgactccagacgattgtccaaggaattgtggcgactgtcccacttgcttgtctgcaatatgctcatcgccttcgcttctttggctccctaagcttcttttgcttccttcttgcacagaatacacaacaaacaaacactcctcttcttctcctgcttccgctcccaccaccagctacacacgcaagacgcaatcttgtaggccacagagcctttctctcgctcggcgcaacccctgatacccaatggctttttgcgccaacacagcttcaacccccaaaaccatggccaaaaagccctccggtccctccggtttcgcgtagactagacacgatcgcaacagccgcattagttcggaaaaacacgcacccggccgacccatcctcacttgctgctcttgtcccctaccaagaatagacccacttgataccatgcataaatcaagtgcataccaaacgcgaacgaccctggtgcgaaaatatcgacgcattccgcggcatcacattgctcacattcagacctctctctctctcaaccacacactcatgcgctctgtccctctcgttcttgttttctctctcacacacgcacacactatctcactcttgctcgctctctctctctcgccacactcactgtcactcttgtcttccgacgttacatctggatagatcctcccgccaaaataaaaatgccgtacgcagtgcatactacttcagcccgatcgccgcaacctttacgccgccagatcgggggatcttggcgatcagcaaagttttttttttttttttttttttttttttgttcatgtatcctcctgttcatatccttctacatccctgtaacagcacccaaagtgacttgggctgcagcccttatcgaaaatgaacagtcatgtctagccaaacacaaatctttttatttctaaccttcgatccatgtgcataggcctaaaatactttttgcacaaaaagctctttggagattgtttttaggcggtctccattttgtatgagctaggttgtgatataaaggaaagacatgcctttcccaggagagtggggatgtcatattccaagaacttgtcacgaccctacggcggaaagagtgtggtggctattgggtgaaccgtatatgtcgcagtcatttccaatgaccacgaagtcagtcccttcgacttgaaattggctgtgcccgatgacgaaatgggaggtctggcctcttcacgagtcaatacagcaatggcacccctggcgctcagggcattagctagcatgctcttgaactccagggtgacgaggggtggctgactttaatgcatcctgaacgaatttgaagtcgcctttgccgattcctatcatccgttggattatggatgaacgcctctacgtcagaatctgtgctggaacgcgacgattaccgccttttccgatttttagttgaatacgaatagacctccgggtccttaaatatattacgtgcggtggtcttgtggagcggaaaggcttcatgaggctcctgctaatgttaatttcagatattgtaagagatacagtatggtgctcatcgtccaaggagtcacgaaggtgcttctgtccagcttgcgtagatcctacgtatagtcccagaggtattcaagcaaataaaaataaaggcaatataccacattcaaaagagaataattaacaattatacaatttacgtttaccttgactagacgttttgtcagttgggattgcatggctcttactgtatgtgctattctgtagggcggcactcaatttcggcacctcgaatcgccaaaatcgacatttgctgctcgggtcctgtctgatgacagtgctgatgttatggaacaacatatcgctgtcgcttgttacgaccgtgatgccgccatccatcagcgctatcctctccgctgcatttactgggcttttcctatggtgaccgagccgaagccttcgcgcgaaggcttgacctttttttttcaaagactgtgaagacaaaagagctgcttcaacaagctctctatgtttctggatagaggtcgtacaagtttgatttgcacgtgtacgagactccatcggtcgcgagatcagcatcgaggtgtttctcaacgactttgtcatgcgcgggcagtacgctctgcaatgcacgtaccctcctcttcctcttgttctgggccaccgtctagatgcacgatccgttgttgaacctccattgctgaatgtttaaaaagatggatacgatgaggttcaagaaagcagcggccctcttttgtggcctggggtgacctccaccttctacatgaacagggaaagcagaaatgataatcataaataaaaaccatcgtcgctctgttagtcctcatctttctacctctgagaaacacaactcctttttttggcatttggcgtcgtttggcgtttggcattttttgtcaaatattttggctcggataggaaagagacataagatttaaaactcgatcgcactgtcaacttactagttttttgaatagtgcaccactacctttctgaggctcattgacggtatcgaaaacttcagtatgagagtgatgccggtaaaagagagtggggaggggaaaggtaggagtgaagcgagatttggacaaagcttgtatgagaaattggttgcttgcctcttttttttttttttttggggggggaccatcaaacttcatagccgttacctcaagagcccctgaatgtatatatcatccccgaccttgcttctgttgaagaatcagtgagggatgacgatggtccggccgcctttggcgggtagcataaagggattatggtcttgaactggtgttgggatgaggggtagccaagcgggtaggagacctacagcccggatggtcggtgtgcagcagccttttctagagtaggttcaccatcaagatagaagacgaccgaggacttcaggtgaccaaccggctatcgtcaacgcgcgttcgaaaatagatgcagccctgtctggtgggtgtgtggcgtaagctctttgcactgttgcgtggagacctgacgaggcgtcgactctcactgtgccttggtgacgctgatgaggtaacgaggccgaggaagagtcatacccttttttttgcgcaccaagggccacaactcgtggacacccatggaaagagcagcgggattggtttgaaggcgcgaagggtctgttataacctttgtagaagagcgagcgagagccgagagaccagcgaagcgggggggttttttgatgcaatgagttgttgacaggataggaagtttacgaatggaggcagtgaacctatctgaaataagcttacaagaagcaccgtctatttatctgtctatgttttcatcatggtggcccccgtcccagggtcaagactgacccacttggagcacaggcgggcacaggagaatgactgcgtgggaactagagcaagcaagtagggacgggaaaaggcaagcctttgatgccaagcatgcctgatgattgcacatatttatgtgtagtcatcacatcacaatttgttgttttgacttcctgcttgcactctatgatccttatcctcctcagatgcccggttgcatactgcgacaggattgtgcatgagagtgagactcatgaaagtagggtggatgcatgagaaacgaggttacaacaataggaaggggtaacgagggtgtatcaggtacaaggtgtaacaatagagaatttgtgaggatgcatagcaaggttgggttgcgataaaaagaccaccaattgttaaggcgtgtgtttgacgaatagccgccttcatcccgtcagaagactgcagtttgcgaacagtgcgtctgaaaaagttttcttatgatgccacagaatagaaccacgtccagtttcatctatctcttggtgtcgagggacggccatcgaatcaacgacgatacatgagagtcttttctagttgacaaagaggaagcgcaagtcttccggtgtcaggcgagcaagcgccgctggatcattgcctgaaaagaatagcgagatatttcgaatgttagttggactagaagaattacaacaactgccaaacatggtcgaaagagagaccagaagacctaccaatagtactatcaaccatggcttgcttcttttcctgcagttgcaagattctgctttcaatagagttttcaataatgaggcgcgtgataagaattgggcgatattgaccaatgcgatgaatacggtccatggcttgcagctctgttgaaagaaaaatgtgttgcaatgtcagttccgagcaggagatgccaagacgttggatcaaacatcatcacggcagagtttacctgcagcggggttccaccatgggtcacaaataaaaacacgactggccgctgtaagattcagcgccacaccaccggccttgagcgagatcaggaagacggtaaccgtaggatcgtccgagaactttttgatagacgcatcgcgttgatacggtgtcatatgtccgtcaagcttgacacactattcatcaacataagcaagcaaattgatgcaaattagcaccgcgcctactgcaccaaacgcagccttccacggtgtcaggcaccactgagcaattaccttgaatcccgccttctccaggcgccacttgatcagatccaagaaggttacatactgagaaaagcaaatactcctataaaaatttgataaactggtcaacacaatttcgacatcatcgccatcaaacaataacacgcgtgcaagaaacatactttgtggaacgatcttcgcgctgaagattgtagaggtgctccacaagagcttcaatcttggtcgagctgcgccatgtatccatattgatgcggttgacgatagatgtgcgagcaaatgtcttgtgccggacctcggcatcgtaatctgtctcatccttgacatatgtgggctgttgcaggtcaatggagagagggatatggcaaacaggacactctggtgcctcaaccgaggacgatgtgatgtactgatctgcatcctcacggcaaaacagatgatggcacttgctgacaataggatcttcagcctaagcaatgggcagggagggtcagttagaaagagctgaaccgctcaactcatagcatcaaacacaacaacaaaagtgattgcgactctacttacttcttcttgacagatcgagcacacgagtgtctctggaaggccaacctctcctggttttacctttttcagaaccatatcaggatgatcgaccatttgtcgcatcttggtcaacaactcaaagatattggcgtagttgttaagaactgttccttgctctacataggtcgtaaacttgcgtttggtgtcactgaacaatgactcgtaaagatcctcttcttcctcattaaagaggtaccgagcgacagtcatcttccggggaggcaagcccaagtcatcagctcgctcgaccttagttcgccgcaacatgatgcgatccagcaacttgcgaagcttttgaaatgccttttctcctgcgccttgactaccatagttctgaatgggcttgagaacttcgttgttccaccaacagcaatggctgcaaacaatgaaaaaacacgtccatgcatacgttagtatacgcgcattcgacacggccacggcaatgacaatgacatccgacttactccataggtctatgatcacagtcgtcacagttcttcatgttgctgtacttccagtgaagggacttgcaggggcactttttacagtaatagtagccataagggtctgcttgcataaatcggatgagcgagtacagttctccgacacggttttgcatcggtgttcccgagagcgaccattttctctccgactgaagtccgaactgaggttcgagaaagaggaatgtgtgggttagatgtgggtatctagccggtcgtcagagtcaaaatggaaaacagcaaaagatacctacagcagatctggcagtgttgcaagaacgctccttgatgttgtgcgcctcatcaaggatgatgcgatgccatttgattcgatgaagaagagaatcctccttgaccgtcataccctttcgcttgaatccatacttttgcttcctgtatccactctcaatgatagagtctagaacaagaggccgatgtataaaagtcactaatacgaaccagcgacgaggatcaagggctgcgaacggtgtcaagcagcatcaaagacttacaagtggtcaacacaacatcgtggctcataagctccttcatgctctctgttcgattaggaccatggtatatgaggaccttcagtgacggagcatggtccgtgatttcgttcctccactgtacaatggcaacagttggtgcgatgatcaagttgggcccccctggctctgacaacagtaaagaaatcatctgaatcgttttgcccatacccatctcatcctaaaattttcaaaggaaaatgatgaagaagagcgagaaagacatgagtattcaacagaaaacgaacactgaaatcgaatatcccatcgattcatcgactcctgccgtagcaatcgcccaagtctttgaatgatgcttactgcaagaattcctcctttgaactagcgtcggacaaaattaaaacgtaaaagaaaacgagagattagcagatgcctgacggagatacgagttcggggccatagcgaactcaccagtgtgttttcttgcttccgcatccatcccaatccctccctctgaaagggcaaaagcttcagctttaatccctcgggctgatccgctagctcgggcgtgtggacggtgaccttatcaagatcatcccaaacgtgccccagctcaggatgatgttcgaggagttgcatattgaccttttccatctagaaaaaaaaaagtgtgcagcccaaatcgtgttaacaacgcctatgcctactatggtcatgtgagtagatccccgtcatcttacccatgtcatggtgggagcgcgagcacgtcgaggggcacgaccacgacgcacagggggggcgggggcctccgactctgacgagctctcggcagatgagccttcatctttgacagagtcgtcgtccgattcgtcattgttatcagacgcagctccgaaatcactgccctcgtcctcactctcgtcgtcactatcactctttttgatctgagccttgagggccgcagtggccttgatcgtagcagcacgacccttggaagatgacgctggtgaggaggatgtgggtagttgtgaagcgggcttgaaagtgcgcttggctagaggagccggtttagctctggtctgacgggatcttgtgctggggacaggcgtcgaggccgaggagcctgctggggaatcgggtgccgaggagagcggggaatcgtccgtgtcctgctcttgcttgagggcctcgatcttgactctggagctacgggttcgcttgaccgtggatggctctggtgctgggatatggacctcgatcttgcgccgctttccgagcgccacggcgctgggagtgaccacggtcgatggctgaaagtcgtcgtcttcgtccacgtccacgtcgctgttcatgtccagcttctgcagagagatgcttgtgttggggctggaggactcggagttgacgatgctgttcatggccgagtcgagggcatcgagggcagtggaggaggaggtggtggacgacgacgccacggagaggctgcgcttggagcgggtggacctggcagggacagcggcggcggtctttttcggtggcatggcagacaattgggctgtgaggagctgaggcaggcgaggacgaggatgggccaggggcgatggggaatggacagcggagcacttgatgggcaatgggcaatgggcaatggggacaatggggagtggagcaggcaggctgagtgggggtgcagcaggtcaaacgagactgaggctgtcggagcgtgaacaggggggagagagaaagaaaagagaaaaagaaacgaaaagagagagcaagagcaagagagagagagagacgaaagaaggtttcgcttttttttttttttttttttttggtggcgcactcggtcaaaaaactggccatctagacttgcgcagtgcagtgcgggtgtgtgcgcggcggagagccaaaatgtttacggtggactgccttttcgttcttggccaggaactttggttttttgtgggtgtttgccgaggcacacacacccatgacacccatgtatccacccccacccatgcacgcgtctgcagcatgacagcctgtcccctagccatcccggagacactctccatcatcctctcctacgtcgacaagcccaccctcctcgccgcctcctccgtatcacgcgcttggcgcgaggcctccatccgcgtcctttggagctcacctgtcgtcccgcatctcacgcccagcttcttcagccagctgcagcgcaatggctgccacgtccagagtctcgatgtctgtctggacaacaccggcggcaccgactcgatcgtccccacggaactcacccgcctcctcacgcgcatgcctcgcctcaggtcgctccacgtgcatctcaaagtgggcgcctctcaagagacggtcgaagcactgaccaggattatcaaggttcagttccggaaccaacttgaagaactcgagctggatatgttcgacgtctcgtccgaggatgcaacagatcttttctcaggactcgtggcgctcaaaaaactggagctcaccggttgcgcgagcacaggggtcatcaacgcagttgcagaagcgcgtctgccacacctgacttcggtcatctgcaatgaaacaccctcgcaactattatacgcgagagacgtcttcgatgacgagtctctatctgccctgggcagagggctctccactcaactgcaggagctatccgcccgcaactttctacagatcaccgccccgggcgtgatcggcttcgcgcaacactgcaagtcgctgacacggctaaacctccttggatgctcctgcatttcgtctatcggccttgataccctcatcgacgcatccccacttctcgttcatgtgaacttgggcaacacctctatcgatgatgcttgtctgttgaagctctcgacgccttctgaaagggctacacgactcaagactctagcgctgcgagaggcagagctcatcagcacagacgcggtggcaggcatcgtccgatcatgtccgaaccttcgatcgctcgatgttggcttatgccgtcatgtcagctacggaatattcaagggcgcagcgtggaagtgcatgggactagaggagctgttggtggacggtatcggcagtgcctctacggatcacccggcgctcatggacgtgtacacacagctgggaaggctttcgcgactgcacacgctagacttgagcggtcagcgtttcgacctgaagctctttgacatgggtcgcgatgccttggagcggcttggtaggctggctacactgaggatatcggactgggcttatccaccttccaccagagatgtcatttggctcgcgactcgcctcaggaccctcagagtactgacgctgaacaagggagctctggaacagtccttatttcaggatctgctggagatcaaccgcaacttggaaatcctacttcctcccaagaggaggctctatcgtcatgcgcaatacaacccgagcttctctgatgacatattatcagaccttgaggagccatacgacagcgattacccacccgatgtctggggccaatacgacagcgactactcggcagacatgaatcccccatccggcaatgaggctccatcaagtgtggagggaccttccgacatcgagggaccttccgacatcgaggccccgttaagtatggagggaccttcagacatcgaagatccatacgacatcgaggacccctacggcatgcaagacccatacgacgtcgaggattcctctggcgtccacgacccatacgatacagatgacccctacggcatccgagacccatacgactcagacgacccctacggaatggacggccccctcgcgccggacgagccagacgacgctgagcactcttcagaaatgtacgaatcgccccacatcggcgaccccagttcggacgcctccaacgagcgcgggttacttgacatggacacggatagtgatcaggacaaccagatggacccaggactctggagttatcgatcctacaggagtgaagacagcgacattctagaggcatcggagtcggacgtggagaacaaatccgaggttgaggaggaggaggaggaggaggaggaggaggaggaagaggaggaggaagaggaggaggagcaagaggaggaggaagagaacgtggaagaacagtgtagtagcactactgacaatcagagcgacgacgatgaagacactgacgatgagcaggaggtgatcgagtcttcggacgaccaagtctcggatcagagtgactctgcagaaggcacaggctccgaaagtgatcaggatagttcggatggctacccttacttcggtggcgatagttcagattgtgaaccttacttcggtggtgattcgagtggcacgaccagcgtagaaaactcggatgaagatcaagaagacgactcggaggacgatcacgcataaacaggaagcgcattcgtcagcgacaattaaagcacacaacgcaagcctcgcatcatttttttcaatgttctttaatgttcagatgggaccctacgagactacagaagtggcaggttgctgataccgctgctgttgctgctgctgtgtctgcgctgcctgctgctccttgtgccgggcaatgagcttgcgcacgtacgccccaacggcctgatggccctcggccgtaatagcaatgagtctccgctttggattcgaccacagcaccaccccgagctcactggcatactgaagcgtgctgtcaaagtcctgcggtcgagagaactgcgagtaaagccatgaggcctgaggccgaagtcggttcttttcaatctcccacagtcgaatctgatccaccactgtgaggggaagaatcggagagtgtttccgcatttgtgcatgagcatgtgcgttgagatacgtgatgatttgctccgcagtaatgcctttagataaagcacgccgaatgctgtcacgagtcaccacgcccgtcaccatgttcggaaaccgatctcgaaggtggacaaacagattgagcacggcgatttgtaagggtgagtctagtcgcggcgaaacagggacaatgttagaaaaagaaggtgtagtttcgcgttcatcatcactatgctaccccatttgtgatagtaaaagttcgtcacaatttcgacataccagtgtaagcgtagatcctgtagttggtttccatcacaatgaagccatggtcatcctcttcttcttcttccgacttgcgtgcggcgccagctgcattccttgaggcacttggatgcgatcccagcaagactggcgtccctgatgttaacgtagttgctagccgcgtgggataaaatctcctgcttccgcgtttcctctgataaacaatgccatatgcctttaaatcttccaacatctgagtctgggtaggcgtcaatgtttctgacgagtaatcattgccaagctcgagtgatcccaactggaaaaagaacgtcagaacttctaccaaatccatgttcagactctcggccatgctcaggtactgcagcaaaaaggcccagacctgcgtgttgatgtcctgtagaaggaactggaatcctttgtgcgtgatcttgggtgccagatcctgccgtgccatctggcttgcaaaatccatcacatccatgttctccgcatcgcctctgtgaccacctgtcattagtccactccggagcagaagattcatcactccagcacaaggagcactgccctgtgtagtaccgaccatataatgcaagatcgcctcccactgcttggtggcaaattcatccaaaaatgcaacgtcaacgtgatgtttatccggagtggatgtcgccagtccaaagctctgagagttgccgctgttcgcattgacaaaatcaaaacacgcactgtgagccatcaacggaaagatatatctactgcggatgcagcctgcacagctgcgaaatcatggcggacattaccctcccgtcaaggcattgcgaaactgctccaagaacgttgcattcattgtataattccctcgctcttccgcaaagatgttgagcgcctttaatctctgcatcgcctctttgtgctttctattcataaataatcatccaagccaaggacaccgccaggtcagtttggaggatgtcgaatatgtttgccaccaattctgaggagaaaacataaactgaacgatgacttacgctgatcctgcaccccccttgaaccacagcttcatgtctgccacggtgataggggtgtctacgtagagactggacatgacgatctgctttccaagtggcggtagtagcctgaagagcacggggcacagcgagtcataaagtagaacgctaagattagaagactggcatcaaggtgcagtacgacaggtaggcaagtccttgctacggctgagaggtgagggcacatccaacaggtgtgcttaccgaaagattgcaaggcatgttgcaggcttctgatagagacggttgaaggtctgtaatggcaaggtctcgaggtactcgtgaatggaagtttggaactttgacatggttgttgagtggggtatcgtcgtgacaggtatatgtgttggcaaagcgatcctcggccccagtggttgatttcctgctgtgatctcgcgatgctctactggatgaggccaaaagacgtcgaatacgttggagcaatggttgagaggaatgcaaccacaagagacacatgctcggcagataaaaaaaagaaagaaaaaaaagagggcacgtgacctgcaagccactttgacttcgccgactgcgatcagcgacgccagtgctggcacggacactgtggggaatggaatgtctagaagacaacgcgatgctgcgaagggtatcatgaaccactaaactactttcaaacccctcggacattgggagctgcccctgagcatcatcgttaggggtgtttgcagcttaccttgcagggacggggctgaatcgaaatttagtgagctcacccattccccgggtcaagggcaaggttgaaagttgaaacgtgtacgacaacatcgctcctctgaacgcgacgcagagcacaactcgccatggcaggtcattatcgtcgcaaccgcaacttgcgctttcggttatgtgcagcagcagaaggtgggccgtgaaatcaagagggtcggggtggtgcctgaacggagagatctcgcctggggccccactgtgcgacaactggcgctctcattctcatgaatttccacaccatctattgcacgccatgcctgtaacacccagctgaggagatgcaagtgagcagtttctgggatgattcaatgcccgctgtccacaaagcactgtaatgcttgagagcattctcttgactaaggatagcgacatgccaggcggctcgatatcagagaatagggggcatcatctcgggtaacaaagcagcctggctgtgagcggacctgccatgaaccatctgcaagaagggtccagaaccacattactacgcatgcccatccatgtgtgataaagcataaccctgtcctcgacccttctgctctctcctttgcaaatcctctcgctcccttgcccccctccattcacattcacattcactccatcccgggtatgcgattcggcgtcatgccacccctgctctgcccattcacacttcttctcgcacttgtctccctcctctccacggtacaggcccaggtcgcccctgcacctgtccaagagtttgcctttgcgcgggctggatcaaagctttatgtccagggaggcaagcaggacgaaaatggcgcgcgggtcggtctctcctctcagctcttctctctcgacctctccgtgagttggcctgtgaatgctccagtgtggcaggccctcgctcccgggcagtccacatacttccttaacggcgtcgtcacccccgacaatcaaaactttctcaccattcgcgtcggcgtcaacaactccttggtcctcgataaatacaacatcgctacagaccactgggccggcactcagacggtgtttcccccagaggagactcgacagggtatcagacccgttatggatccgaacactggcctggtctacatgaatgcctggtccaatatggatgtgttcaacccgtccgacctgggcgtcactctcaagcccatgccggcaaacgtcttcacatcgagattattttcaggtgcagtctacaacaaactcagaggatcgattctgtactatggaggtttgaatgccactatcaagcttgaccctggtgccacatatgtcaccgagtacaccatcagcacgggcctttggtcaaactttgtaaggactcgtctcgccagaactgaccccaggtatcaactgaatgactgcacacttatcagctgctttcattctgcgagtcaatagaccaccagcggtactccgccagtacctcgagcagatttctgcatgacgtccaatgatgagggcacaaaggtcgttgtatacggaggacgcgttcagcccgatacaaccaccaccccgcccacgcagtttacaggaaccattcatgtcctggatcttccttcaggcagatggaccgaggggcctgttgggactgtccgcggctacatgggttgcacacttgtgggcgatcaatttgtcgcttggggaggatcggatggcattaacacgattaaagggccacctgtaatcttcaacatcaacacgaatcagtgggccatcgaatataaacctccagcttttctcgccgctaaaccgaccgccagcataggaggggctccgcctggctcaacgacagcagcatcgtcgtcgtcgggagactcgacgagcaatctgggtgcaattctcggagggacctttggggctctcttcgtcattgctctagcaggaatcgtttacctatttcttaaacggagagaggacaaggaaaagttcggaattgcatcagaacagcaactacaggacagatgcatgcaagagaggcttgaggagcctgtgtcggtgttgcagaatcgacagttcagtggctcgcaggtccggagtccacagaataacaacgacagcgaccaaggtcttcaccgtgaccctcaggacattcactcgatgaactatcagattccaagcccacagcgacattttgtgagccagaccaagaatgcgtatgcgccaggcacgatgtacacccaaccaagcgcactgacagccgtggaccaacccttcaccgccaataactatgtgatcggcacaaacggcgaggtctacatgacgtatagtccgtctacgactggcgcgataagtcaggacgtcagtgcctatggagtctcgccggcttcaagccattatccttacagcggcacctacgctgtgcctgcctacacttccaacgcgagtatctactcgtctcaagcagcgcctgtgccaacaaatgccgccggctataacgcgtattcgtcgacagtctttgatggcactagcaataccttcaacaccaatagcagccccgcgacaacaataacgacgacggcgcccgatggcgtcgtgcaactaaatccagtgtctctcccacaacgaccagtacagggcgagaggacctactactcggttggcatgccaggatatgtagagggcgatcggcagagccaggctgcgacttcagacgtgaatagcggatatgttccaccaccgcatccactaccgccacagtaactgaacgttagaatagtacgaatataaatggataacatcattcattagatcaaacatgcggacgcaagagattggaactgcgttcatttggatcccaagctgcatttgcggtatgatagcactttgtgatcctccgcgataccgctccactttgcgcaaagacaacggtatcactgtctcacgaaagtccgagcgatagctgttatttgaagcatgaactggtcggcgttgccaaagatgtcgtaaacaaagctgcccagatgaatcgtgaaaattgagtgtaggagccctaattgagtgggcaaaacatgtgatctacttttgttctcacgaaggtccgattttcagctcaagccgacattcgtgcgctttgactgagcaactttgaggacgtgccttacccatgtttcatacatgtatatacatttattcgtactcacggccagccgataggttcacttgtggttcacagcagatcacagcctattcttagcgtggcacttgcgtgagacccgctacggctcccagatgtgcgaactgttgccattttcagcataattgtaactttgtcacataacgatcgcgcgccttcataaacccgtcgcaccatactacgccctgcatttcacttttgcttcactctctcactcgttccggcagcagataccgcttttcaatgattcgatcctctataacagacctggtcctcacgttgtcgctagcaactttgtgcgcactggccgctccagcagctaatgaagcctctcttgatgcctgtggttcacttggagccaagaatggacttaacctcgcttacgcagatgtggctaattgctataagtccatcccgttcgacaacaaaatcgctgcctcgactatggacacaatccagacgctcttccacgactactacatcttccgtgactcggccttaacccccaatctgcaaagcccattcacttctccacctgtcgacatcatgaaacaactaaagctgcttgcagaaaagaaatatgcgaacgacttggagttccacaccgcgatctctgacacttttaatagtttgaatgatggccatgtgcagtacaaaggtacctggtgtgaacaaagatccatcctcggcccttatatgcgttcgtcgtgatctaacgcatcacctgtgtatcgtttagcttcctgttatcagaactaccagttcaaacagtccttgctcctctatgctcctgttgtcgatggcaagcaagtatggcatgtgctgtcttccaacggtgtgcatgctgtttagtcgcgccatacacacacttacacagtacggtatcattccgttcgacccttttcactacattagcacatccatgtctacaaagacgctctcaatcgtggttatgaagattgtattgtcgagacgatcaacggccaagatgccttgacgtacctcactcaatggaagtccggcgtttcatactccaaggacgctggcgtacgcttgaatcaaattctggctacacaatactacaatcaggaagccggtggaatccaggtcgtcgcaggcgatttttcagagcgactcttgctccccgaagctccctacatcgactacaagatccagtgcaagtcacctgccaggcccatcgcgcttcgagagaagtggaccgtcgccaacatgactgaggcgacttctttcaagagcaccaaggaatatgttgcaagcgtctgtctcagtggattttcatcgcaagagagccgtagcgacattcgggtgctgggatccgatcctactgggcctcgtcaagcggcaagccccaggagatctatgctggctaaacgaatgcaaacatctcccgttacggaaggtgccatagtactctacggtgcggatctgatcatgaaggccaaagccgtcatcttttaccatcttaaggaccatccaaaggttggggtccttatcgtcccagagcatgtacccagtcggaatggaaaggatgatctccttaaaggcctgaccgagttccacaagcgaaacattaccaacatcatcatcgatctccaaggcaacggcgggggaaaccccagctactcctacacattggtccgagcgttctttcccaatagggaccagttcgatatcgctctccccctggatttgagggccgctagcgagactcagaggatggcagccgcattgtatcatactccctggggtaacacatatgacgcctcgtcatacaccaactacaagaataggactccttatagcagtgcggacatgttcacacaccctgttcaactgactcgtaatggccgtactgacttttatacgcagttgtcgaccaatgcccccttgaacacgaggtcgcaacctcagctggagacatttccatggaccaacaagccaggtagcatccacattttgacggacggtcgctgcggatccgcttgcgctgtatcggcgcatatattctccaagctcaagaaagtttccgtgaccgcggtcggtggcatcaagggccagccattgtcaaagtttacgtttgcgggtggagtagtgggggatctcgcaagtatccagagccactacgattcagccaagatgaactcgtccatgaaagatctcccatatgatgccacggtcgaccttcccatcgcagaggtctatgcgaaaaacagcgccatccctctcgagtacgatgctgttgcttacacggctgatgtgcatatggactttgatcccaagaacgccagggaccgtgtcgcgttgtggacccaagttgccacccgcgtttggaaactgtagaagctgtatgagtaaacgagtctactttatctccgcttcttcttgagtgtgtaaattctcaaaacttttttgtccctgctgaactctgctttgagagagtccagatccacaggctcgttaggcaggtcaacttctacatggtactccttgccaccgtccaggctttgaccctgactttgagaatggaataccagcttgtcgggcaggactacatccagggtgacaccgtccatggatgtctatgtgtcagatggaatgtacgatgtgagtctcaacgcttttgtcatgtatgaaaaacgcatcactgtcctgacaacagcagaacttcaagaggccaccgcttacgtgatttggtagatcaatctcgacaatgatacccatggttcccttggggcatggcgagagccggctcgccggtgcaatgtcgtcttttccagccgaaggcacaaaaacagcgctgtcccggggttgaacggcctccgctagcacgttctgttgtaatttcttgagcgtagattgcattgatagagtcgctactggtctctcttcgctcggtttactgacttttccgacgttattgacgttgctgacgttgctgtcgagttcctgtattgctggcggttttggaagaatcacagatcgcttcttcagctcgtcttttgactttatgttgggcagttggaaatctaggtggtagaataaaaaggcagtgctcaattagcctgagatccgataggtgttggtcatgttgtcgtggcctatcctgtgcgctgaagaatagggctgagaaggcaggaatggcacttactcctgctgagttcgacacgacacttttcttcgacccactccatggcgagttccatgatgtacagcttgtagtcaaagtccccttctgctctcttatagggttccgtatggatacatgcatccacgacaagatagctcttggccactgcgaaatagcaccaacagaaaaattcatgttagatcgattgtttcaatgcagtatgcacacccctagtcttttgaacagcggtggttaaaggacggggttgtttttttctacctgaatctcgatactcccgaggtggacttagttgaaacggcacctgataggtcgttccttcctctgcattgatggctttttggatctcggcctcggttgcgctggacggtttgggcatgagatcggaagaacacacgttgataaacacggcagtgcctttaccaaagctcacgatcttggatccgataggcaccttgctgccttcgcctgtggtcaatgtctggacgacgaatcctggtacaggggtgatgtcggtcatggcgtgccgaggcgcttgcgaggcggtcatgtagctctctgcaagggcaagggcggcgttggggttgctcttgaattgggcgaggagagcatcctcgtctgctgcgtctctagcctcggctgactgcgctggggatggggacggagcgagagagggcagcaggaaagcactgcccttggcatccgtgttgtcaaagtcgaggaatgacattgtgggatgggtcgacacaacgaaggaatggaccagcacaagcaacggtagaatgcaggtgtgccaagggtcgcaagtgtgcagggcaggcgagcaaatgaaaagtgtggacagcgacaaagccacgttgaggcctggctgcctgcctgcacacccctggcacgcacgcactgttatctcccgcctgtcgtgtacctgcactctcctcactccttcacccgcacgcacacactcactcgcacacacactcacactcgcacacacacactcactcgcacacacacgcgcactcccccctccagtcgcatcgcacagctgcatcgcacacctcgtcctgcatccaccaactggccatgtcgaggagaccgctctccgccgccggctcagccccgtccacagccgtggccgcgggcacaatcctcacgcggtcctggctcagaacagcgttcgcattcatacccttcctggccctcatcacctcggcatggctctatgccatccacctcgacaccctcgccaaccagtccatggtccgctccaaggctggcactaaagcaagccacgccgcaaggaccgctgcagaccctcgggcggatcaggacagcaccgtcattggcgacagcaaggacaacatcttctactttgttcaggtatgcctctctctccactcccgcttctctagctgtccacgcctcagctgctcacatggtgtttcccccccgcaatctccttcaagtgatatctttacacaacgttgtcctttttgttgtgtgttgtgcccgaatgtgttatttttggacttttggccagtgcgccacaacgccagagcaccagcacacacaccgctggggttgcacagccatcgcacacattccagcactgacagccttggtggtcccacccacctgaaaacactttagactgactcctcctgcccattccacatgctgcgtgcccataggtgtcagatctgcacatcagcgctttccggaaagcaagcactgccaacttttacacctttctctcaacggccctgcctatggtggaaccagcctttgtcgtcgttacgggcgatctaacagatgctaaggacaaggacctcgtgggatccatgcagtatctgagcgagtggagtacgtacagagacgcgttggaagagtcgggcgtcctggccaaaagaaacggcacgttctggcacgaccttcgtggcaaccacgactgcttcaacgtccctgactggaacagcaaggaaaacatgtttgcaggcatgagtgccaccaaggctccaggcttcatgttcgacgtcaagacgaactatggcaaatacggcttcatcggaatcgacgcctgccccaagccgggccctgcaaggccttacaacttttttgggctgtttgaaaccccggatatggactatctcgcgcagaggttggagctaagcaagggaaacaatcataccttcgtcgtaggtggtagtggagtttgctgaaactactcagttgttattgtcaagcacaaacgtaaccagtctcaccggatacaacgctcacgcgactttgcatgccgttcattattttcttatagttctcccattacccagtgaccacgaccgtctttggagagacatcctctggtgaaagctttgctgatctctcacagtcctttagcgtgtacatgtgcgggcatttgcacaaactcaagtggggtacgtaacttatcatcacttcaactgcgatgagttcctaggtacggtccgtgagtatttaatgccttcacatttcccaaatttgataggcttgggggatgctcttcagtcgtaccagccgacacatttcttggaacttgaggtcggggatatgaagcagaacggactttacagaattatggtcatggatcatgacatgatctcgttcacagacgtgtcgatgcccttgaccacgattccaccggccatcatgcccaatagtgagcaacaggagcagacggaggaacagctcgtgtcagatgacgattcgacgacctcagaccagtcaggcaagaaggaggcaaggaagcatccggtgcttgggcggcgcctgcccacgaacccaatcatcgtggtctcgaatccaaaggactcgcgctacctgatcccaaagcacgagccagtgggtcgaatcaggaccagtacgcacatccggttcttggcttggacagataaccaaattccagtgggcgacagtcatgagcatgtgcgcaaggagatcaagattgagatcaggatcgacggcaaactgcacgagcaacctgcgcgattcgctggaacgacagcagaagaacagacaaaggacgaggaatttcttccgctttatgtctcggcatggaatcctcaagattacaatgacggaaaggaccatgagctggagatcaagatcgtggacagacttgggcgcttgggaagcagtcgcaccgtcttcagggtcgatggagaacgatcagaattgaacggaggatttgcagaatggatcatgtgggccaacattgccatgcttgtacgtgggtcttgctcgaccgagggacgtgcgctcattttctgattcgaaactttgatctcttactcttaacacccacttttgtttcgtgttcttggatgctgtatatagctgaaggccctattcacgacaggatacctctttgtggctctcatcctgttgatcttgcccaagctctattctctctatctgcagacgtctccgccccctccagcaacgcaggcatattccaaagcggcgactgatatgaccatgtcgcatgcacaggcatcgttgaaccaacagcacacactccagttcaagaacggatacgacgcatggctggacgaaaaatgtcgtcacctctaccgtctctcctcgacgctctcgtctgcctcctcccgccacaaattctggaatcgattcgtcaaccacaccattcatgcgcacgtcctacgattcgtccatttttcaacccaacccatcttgttctacacgaccttgatcttcacactcatgctagtgacagcaccccagttttggggtaacttcattccgtccgcaggtgagcaaggccaaggatggttctatcttcaaggaatctacttgcctcatgctgggggccatttaggcggcggactacgagaagcgagtctagatgctgctggacctgcgagggtgcaggagcctctgagtgtgctcacgggtgcgctttcgtctttgacaggaggacggcttgtctcctcaagagcaaacgatgactatgatagctcaggaggagtcggagggacttggattcccatggcggacacctggatgagcacgatttggacggtcgtctacgacctcgtcattttcttgtattacctcaccctgtgcgccacaccgtccggatatctgtactcgccctccaacccacatcgactgagaccttaccaccggacgtggtatattcggtgcctcgtctttggaatctgggtcttccgctgctgttcggtcctcatgaccgcagagttgtatggacccagtgttgtgtggacaggcatcggcacatggtggctgatcgttgtaggatggctgatgttcatggtcggatggagtcgatctaggatcgagagggatattttactgcggcgaagcgaggatggcaatgaggggcagcagcgctttgctgaggaggaggaggaggaaaatagcgtgctggtgggcgagggcgtcgatgtggaaggaaaggagtatggacgcacgaggatgttttcacacccacacgagaccatcagtctgattgcaaggaaggagactccccagcaggagcagctggacgtgagcgatgaaatggaagaggtggaaggcgtcaagacaagccggcgacccgccaaaggtcgaaagacttagcatgatttgtggacgacgcttgactctagaccacaaatatcacatatatgtaacgataccacaattttcctctatgacaccagtgagcatcttctttaatggaagtcgtaaatagacaagaaaagaagaatgagaggaaggcggtgctgtctgaggtcgttagcgatgatgcctgtgtgctatagactgtccctgcggaactcccacacgttggcctatcaatccagggctcgcattttcactgtaggcatgatcaagaagcatggacacgatccctgtccagggtacattcacaaaggtcatgcagcaccgtaagctctgaggctgcttgacaagcgcctcaatatcctgcctcgatccgacacctgcagcgcttattatcccgctcccagggccgtcctggaacccgcttctcgtagacgacgtcgacgagccgggacggtttgctgatgctgtcgcttgcgacgcttgatcggatccgaggctgtgagtggatctgttattgttgccactgttactgtgaacgtgattgtgattgttgatgacggaagaacttccgtccccgtctgcgccatgaccctcgtagcttcctcccgtcgcctgtgccaaggtcgccaaagatatccggcgcagggattgaaagaacgaacccggggtgaaggatcgggcaggtgggctggtcccgctggattttgaaggcacgggtggcggtgatgggatcgtgatctgcacttttgttggtggtgtaggtggttgctgcggggcgtgatgacgacctccaggagcgccttcttgtcgatggccgtgaccatgcccgtgtccgttctggtttggaatgggaggcaagatcttttctgaagacccgtattgcccagattgccgtcggtggacgggtctgtcggatctggacgtcccatccctgcgaggcgagctaggccatgttggtgatatgggtgatgtgggcgagattggagagcgggcactttcctccttgtcctccagcgaaggatcgtcccttatattcgaggctgtaattgcaacctagaaggaacaaaggccattgatattcataaacagtgctaaggacacatggcattggagggttcgctcaaacgattctggtttttttttctcatccataaagcaaggcttctgtgcccaagccccgccaattacctgtgcatgtccacgacctcctggcccgcgcatcatgacaaactctgtcgggacggtatgtggccccaacttgaacctccttccaactttggaggccgccttttgctggtaaattcccagaagattttgatacccagcagcgccttggaacaaggtgattttgctgccgccgcgaatggaggtgctaggaaagggctttcctatttgcaccgcatcgttatagtggtggctcctggacggcggttgagtccacgacgtctcctggtcctcggtagctccatgtgggcgtgatcccgaggttgcaggaagggtcactgccagttctacacagaggtactcgttctcgtggaccatgagctgctcaaacatgtcttcaaagtcgtcgatgacgtagtaaatcaggggccaagaacactcaacagactcctgcttcacatccatgcgtgattttgtgggcagcgcgtaaacccgcttcgtaacatgggtccgtgtgcatgtcatgctcgtcttggtgatgcctgtaaccggatttgtctctgctactcgcgaacatactgccacagttaacttgcacttaagctgcgtcccgtcgccaaaaaataggtttggttcgtaataagttagcataatgacaaaaaaaaaaatcgtaggacctcgatttgcgtgtttgctctcacctggacaatgacgttcaaaaagaacgtgtccttccacaagacaacagcctcctgctccggcgtcagaacccgctgcccgccctttacttttcgctttacaaaaactggatctacgcctaggccaccattctggacctcttccgaggctcgttgaacgtagaaaaggaggtcgtcgttggtatcgtccgactgatctgagacaaagtattcatggaacagttggcgccatctaaggcgatatacaagaatgaggtggttagtattcgaaaagcagatttgacatttcgacaagcgcttcctccgctctagaggagggagcgttaatcacgcatcgcttcctggatacctaggatcacgaccatccatgtcctcgtcctcgtgcgagccatgtatatcgtcctgagggttgtttgggtcgcggttagcttgccggatcacatggctcttgactgtgtcctggtttccgggatcgatgggtccgtgaaggttctcctgcaccagtctgtcgaggatagaccttaggtcagacatggcgagtcttgatcaagagcaaaagcaagaaggcctctccgggacaaagaggagagcgagtgcaaatagtaaaagtgtaagacaaacgaggtcgaatatgaacagtggaacacagcaacagtttgctcaagcacagcagaggggtcccaactggtgtgaaaaatgaggtgtgctaaaaaaacataaaagaggcgggtctgagtcgagggtcgtagcacgaggtgtgaatcgcagggagcgcaagtcgagatcgaagaaagactggagaggtggtagcacggaggaatgcgaaccagatggggatggcgaaggagaggagaagagggaagagcgaggaggaggtcattcttctgcccctcggcacctttgcgggacgagatagaaaggggactctggtgtcacgcgtgacagccctcacagcacggctgcattcatcaccaggacggacgagcactgcatggagaggggctccccgtccagcgactcatgcgattggaaacttgctcagaatgagccggcgatcatggcggacccgtctcgacagttctcgaatgcatgctgggtgccagtgccaagctgtgctgaaaaaccgaaaaatgcttatttatttgcgacaaggcctatgatacaagtgagcgtccgcccctggatcacaccatgggctgacagctcgggctctgacaggctgctgcagatcctttcatggccagctccagtgcctgatctattgtcatcgtgttttgaaccttgggtcggggttcctgaacggacgtgcggggactctgtgctggggagcaggtggtcgaggacgcggcagatgctgtcttgttcttgaatatcgcaaaggagttcttggagggggtcattgcagcagctttgtgtcgatggtgtcttttctggcgagttcagagtcgaaccgagaagtgaaaggaggtgctttttatcgatttttttctttaacaattcaaagtccgagaccatgcacaaggcggcaaaacggataccgagaaaacgggccacgggccactgactgaataaatgaagtcatagatgacgcagcgaaagactcgtgaggacgttcctcaggaaatgaacggctgaaccagcaagtccagaaaaccaaagcacaggcattcttcaaaattcacctaccaatatatatatctcgaggaatgtcatgacacgggaggagttcagttgataccttcaaagtctgtgctggccgagccggaaatcgttggcttggagtgaaagcctgcacagcgttctcattactaaaacacagtagggaggttacgatagcatttcagttggaaggcagttcgtcaacccatctagacctctctctctcactctggcctatctgtcaagaccgtttgtgattgattctccgggtttgcgtctccggtggtgatggtagcaggtcgcaagtacctgctatatgccatgagggtccacggcgggacaccttcctgattgctctggctggctgctataacttttagggaaatcgaggccgccgagagcaaaataccgataccagcattgctgtctcggcccctcgtcgcgtacccggcacgagccgagctgcaaagaggattgatgcacctcacgctcccgtggatgggttttagcttcaattcaacacccaccagccgcctggatttcgattgctccaatcgctgtgtgcaaaacacacaggccttgctcgtgtagtactcgtaagtgaacagggcaagcacccctgtctaagcagttgttcccgaatccaacgtcccccacagcgaagatgaccgccgatactactaccgacccctgagccggcagcaccgtaggcgacgaccgtcaccacatcaggccgagctctgggacatgtctgtcggtaagccagggccgaatgtgccttgtggcgtggcggatggtgctgtctgcacccgcggcaatagcctgtgcgtgggcccacggtaactgagctgccctcgggtggtgcagtgctatgctcttgcgtcgatctctttagcgtcgcaacctctcttgccttggctcttgcctttctgtgttcttgcgtccgacggagattgcttagccgacgtttggattccaggacattgagcgggccatgagcctcgtgccgtacggagtagatacgcttcacatcggcgatgctccaagcagtcttcaaggagttggatggagttgagatccttgactgcaggcggctcgcgtcctctgcttcttcggcaagcttctcgatagtgtcctcagcagctcgtgcccgttcgatcatgtgttccgcggttggagtagccgtgcttgcccctctcttccgcttcgttccatggtggctcctccgaggcctcttcttcttcctctttctcttagagcggcgggtcctaatgtccatgagccttttggtgaacgagacttgatgcaaatgcttcactttggtgcggatcgaagatggtaaccgaagggtgtggagctccaagggcggggtctcctgatgctgctgatcctgggtcgtatccgactccatctccactgacatgtcctcttgcgatggctgcttagtctccgtggatgcagcgtttatcgaaacaaactggtcgttctgaacgctctggctcacgacatcagcctcgtcttccagcctggcctgatcctgctccagcaatgcggtgttgaggacttgactatcaggtaacccttttgtattgacgcatttgcagagttagtcgctgtgtgcaggataaagccgttcagtgcacagcattgccaaaagtcgttccacagtactcacattcaaggacctttagcctgttcaaatgtcgtgcgagctcgttcgtagactgtgggactgactcgagtgtgacacatacacctgggtccgccccagcccaggcaatgactttgttggggtctcgccttgcctcggccaaaacgtcactcaagtcgatccggcttggctcgtcctccacagcactgcccttccaagcaacatgaattattgtgggtgcctgacaccgcttctccttgttctccaccgcaccttggccaccttctccagcttggcgaggtagtagccctctctcctcagcactgccagctgctgctgctgctgggctagctcccaaggaccttgatccgggctgcccttgagcgccttgacggccttggcctgtgccttgaccatggtcttagagtgtgcacaggctttatcgatctcgttgtgtccgaagccgcgctcttgccagtgatctagctccttggaccaaacgtacgacgcaccgccggtggccttgtgttgttctcgtcttttctcgtaaaggctctcaaccggatggccaaggcgttcgttgccgtgaggtatcagagttccttgcagccgcacggtgtctctggatacgaagatgaggctattttgcatcattcacaggtcgggacgatcctttgttaggcagatcactgcatttatgttcgaacgtaaaaaaaaaaatggtgccagatattgggactgtggaccttaccgattgttgaagtgcagattgtgcgcgcgacattcctctgccactctctcatttctacgcgcaccttcctcctttgccctttcactcactctcagtctcgttacttcgccttgacaaacatcgtcgcccacacgcttcgtctctgtcttgtttcattctccatcaaaataagtttgctgcatacagtaactcgtcttgctttgaccgcctcatcctcctctacttcttcctgttcagcataaaagccaaaaaaaaaatagaaaacataaaaacaaaaaaaaaaacatctcttctcatcattgcatttatatccacgatttcttttcgcctcgatccagtatctatctctattgtgcttctttttaccctcaacagcctcttcatcgccgccaacgcgtctcctgcgatgggcgtagtgggcctttggccatacattcgcaaaaaaggctacgatcctgttcttcgacaaactaccagcatctcagactcttcagcaccaacaagcatcagactggatgtcctcggaacacatttcgccgtcattcaagcagcctactcaagacaccctccagatatcgcgcataccatactcgaaagagcaaatcctaacgttcggcagcgaaagaacgctcgttctgtatctcgacggcagccccacagagaagaagtaggcgacgcaacaagcgcgtgaggcccgacgaaagacggcgcttgatctagcacgaaccaaggtcgcggagctggaacgccgggtcgatgaacaacttcgcgcaaggaagcagcttcacatcacgatcaagaagaatcttagagctgggttcacttggaaccgagagttgaaaggcgctttcgcggcctatatgagaggaaagggttgggatgtacgtgaatgtatgacggaagccgacgttgccatcgcgcagaactgcagaccgggagacgtagcagcatcaagggatagtgattttatcatttacagcaacatcactacagtctggagacctataacgcggtacaagtttctggtctacgatgttagggccgtgcaggtcgcgctgggtccgaatcgcgtgcagctgacagtgctgggagtcgtctcaaaaaacgactatggatccaacatttacagcttggggccggccaccaaccacagtatcgtaaagacactcaaggcggaaggtaaagttctttaaagcgaccgatgacacccttgccatgatcaatcaacaggctctaatcaatatctgcgcggcgctgcattttagatccgacgaaaatggtcgatgagtatctaaggcacagcctcgtccgcagtaggaatacctggagccggatattttctcatgctaaacaaggtgctcagaatcgtagaatatctgtgagtttgtttatctctttctttcttttcgacttttttctattattatgagacttgcgcacctactaagacgcttcttcaaatatctaggtgccatatcatcatcaaccctccttacaagactacggacccgtcagaaagggattgccttttaatctggactcaggtctttgggattatggcagccaaggagtcgattctgagtggggaagggatgctcgagtcgtccaaactgctcaggaagcaacaggcggtggaatttggcgacctctgtgacgccggccggaaagttgatctcgccttcgcgttcgaggatattgaagtatcgaacattgagttcaaacgaccggaccttccaaacaagtccattactatcgacagccgaaagaacattcgccttggcaggtgtatccaggagatgcataaggattttggagtacaagacccctccgtcatcatgggagatgtctttggtaagtacagtgcactcggagttgaatgtaaacctatgtagtattgaacaattccactgaattttatctctgactcactacctcttaatagggtttgtcggtatattctaccagcttgcaaagatggatgaaatatggatcgcgggtaagatggttcagtcaacagtgcagatccccactactcctggatccatggaatcgtttctcgaaggcaattcgctggcatctggaattatattgttagttatacgctgtgtttatatatatttgccaagaaatgaaacgacgcttatgcggcgttacactcttcttttaggagtatctcgaaggccaaggaccaaagatcaaaagagctaaggagcgtcacgttcgagaattagagatgaaggcatttagagaggccgtatcttcttcgcggccatccacaccgcccctgaaattcaagacctttggtcatgttgtcaccttttcgcctagcaagaagcgagacacttagtctcttccttgaagtaaagccagccattactgtgtcattgtgtgttgatctgggtcaacactctatggaaggtagggttgaattggaggtagtgaattgaggctttaacaatagatatcgtcgtgagtgtactagggatagttatcaacaaggtggcttcccaaagctggtctagccatgggggttcttgcaggcaagttaaaacgtttttttcggctgatcatgttatccactgtatgagggcataattgtctcacacatatccaaaaatacaacaaattctcacccccgccccatctgtgtgtttaggtggagctgccagtttgttggcgggaagtattctctccggaggaatgcaccatcacgactactacagcggtggttattacaacgacggtacagtacctgcagatgtcacgtatgtgggaggaggcgaagactttgcagcggacacggaagtcatctcttcaggatacgactccgaagggggcgattttggtggtggtggaggagactctgcaagcgacttttgagaatcgactaaacataccgtgttcaggtgcaataaagtatcgtactgtggtgtctcctggcatacatgcgtgaaagagagatcgtacctgaacttttaaggttcatttgacggcagttggaatcggttgcagaacggttgcgtgcagtgccttggaaagccggaccattatgtttatgaaaggggtcaacactcctggaacagttggaagggtttaggtggatggtcgtgtgaggcagtgacgatcttgaggatagccttgagaagttgttttgatcgccctaggcacgataatcaagctctcttttttttggtacagcaccttcattggagatatcatgcggtcaggccactaatggaaacgtgcaaggccattttccatcgttgcaaagcagtcaagggggagttcggcgcataatcgaccaacggccgccaagctcatgagaacaggcaacgtacagatatagggcatgcattttgacacgggttggggttggaacacagagttgatttgagtgaagtgatcggttgcaagctgattatgtggcactatgaagatcggagcgaaaagttgtctgtgacgatggatatgcttcttagtgcagaaggtgtcgacggcgagacctcttcatgtgcatgctaaaagatattgtcgatgccaaaggattgtgaacgccattcaaaagttagggatggaaatggggcacagaaaaacgacgggaatatggaaaaagggagagggacgattgaatggaactatccaggtcgagacggaaaacacatcccaagagagagacgttgccaagcaaccacgccaatgggccacctgacaataccaaagggtaacgtcaagggactacgaagggacagacaggcggaggatggagcatctaaaatgtacgaagattgatggaacggtacgatagtagatgtaggtcgtcagggacagaggagggacgtaaggaatacgatgggagggcgagccaagaataaagagtggaatggtaggatgaaaagaatcaggatagagcgttgaggaagaacgcgttgcttttgatcctccgatgtccgtatgtcaccccatggccaccttcctcccccgtctcgagaacccttatactcccccacaaaaaagttcccaaaagtgacagcggattgttacgcgtcgttattttgtagttacgcactgagcactgcgggcgttcacacggcgatttctcggggaatgcgaccatggttttattttgcggtacctcggctcggatttgtgctgtctgaggtgagcttttccatatcgagagagtcgtaagggttgacatcctgtcttcttgtatacatcttctgtccgagatagatcagcacggtgtacaccatgccgcccagggagccgatcgacgtaagcagcgtaagcagcaggtcccatccagtcttgcgcgagcatttggagcaagtgtagcccactgcaaatttcatgtcgctgttgaccgcaaacgtttgtgccattttgcgcttgtagactgcgtaagtatagagcgactctcgtgttgtattgtatggctgctgtttagggcggaatatggcgatctcgccgttggcatcgcgccagacacagagtttgcacgaagcgttgacgacgtccactcccaaaggtattcccgcaccttctccgtcgttgtcggcaaaaatgagtgattgcaaaaaatgcgggctgccaggagagcattccacttgcgtgaagtcagaatcccaaccaaaccccacatcgttggagacggtgctcgcgatcaaattgaatttgacttgggccgcatcatggaagaagcatgaggcgttgtaattgatctgcgtggacctatccgcatttagcacgatgcgataggtggtcatattcaggcaagagtaggaagtgttcgtgtatttgtagtctgcggtgagtccagtgatcctgtcgttgtagacgaatggtaagatgccatcacggctctgtcgcacctcggctccgttgtagaggtggtagggctggcatttgtctcccgaagttgtttcgaaagttggagatgtgtatggcacacagtctttcttggtaaataacgtccatgccgaaataccagccacagcgacaagaaagaggaaagcgatgacggcggtgtatgtcttgttgaacgacctgctggttggatagctcagtgttataagcattttttggatcttattggcaaagtcagcgatcagtgttgtaatagatagcagcatgcaacttcgcatgagcaatatgtgcgagcaatttttaccagttcactaacgaagttgagggtgaggcatgaaaagagaaagaaagtacgcaagaatggactggtgggttcgataggcatcttataacaccgaggactttacggctgggctagggctagggcttgcaagggcttgagtttttacccagtatgcatctgacgcagagcatgcaggtccgacctcattgttacacgatcgatcgcgcccatctttcaaatgcagctcctcaggccagggcgcagtgacttttactctccagtttttctcagttcagcatgagcctaacgaagaacccatctactctctaccagcgagtttgcggagcgcggctgcgcgatgtgaggcctgtggagcgaccttccgcggtatctgcacccatctttgagcacgagaaactcacccacaacacgctctcaagccagctccagggaattcacactcgttgcactgacaccggcagtcaccagtataaagtaaaggcagtttttccggccaatgtaaccattggaatacgagatctacttggttaacgtgctcgagaggttcataagaggggtcgtgtaagaactgccacccatgcccgtatccctggttatgtttgtgtgatttgaaaactgggctgtgcagagtgcccttgctcgccgagagaaggcctaatgtaaccaccatgccatggtcgtacggatgaggtgtcaagatgaggggggtcgactcgcgttagcatgccatccagggagcacaacagtcaagtgtctagtttcggctacacggcgttgaggagtcgagaacatgagcgacaatggctaggcatacaagtaagggatgcacagacactgatacaaatgctgcagaaactccttcactctggaggtctgaggggttcacagctgctgccgccccatgtgtatgcacccgctgctcaataggagcagcaaaagccgctgggaccctcatccttattcaatccatcacttcgcccggccaagagccctcaactcctgccatttggaccttgagatgtcatggtgcttccccgtataccgcattgtctgcacagcagaaggtcactttattatattgtaagatgtttgtagttctccagaacagatctttacttcgtcagcacctggtgtttctcaatcagcgcttccagatctgacgcttcatcccctttcaactctgcgatcttcttgttagccctgtggaactggaaagtaggcctttgttcatagaagcagcctatgttagtaggatgttattccaaccgcgaaccttcattcacaaatgcgatataaactcacatcgctgtaacttctgcatcatccgccaactccacgaattggtcaacatcgaccttcaaaatgatacagcaggtcagtgagatcatattaatacatacacagcaatctatagcgcacgaataaaagcaacaaccgctgacggatcatgataccttgacaaaagcaacttggggatatttctcagagaacttgtccacaaagggcttgatattcttacatggcccacaccagttctaatacaaaggcaggactttcagtgctgaatatggcattgagcatgtctgcagtatatgtccgcaagaaaagggtgcattgttcataccgcggtaaattggacaatgacctaacaaaaaagagacgtacgtcaggcattgacacggctgagtctttggcagtacgattctgctcaggatcgaaaagacttacaagtttgctggcctctgacttggagaggagctctttgtattcctcctggctggcgattgtagagacaggcatagtaatgactaatgattgagaattgatggagtggttaacaaaaaggttttctaagtcttgctatttaaactgttccaagagcgttacccgactcaacactgaaatgcatgagatcctttgcactgaggaaggtgataggttaccgagcgccactctgcatgtacagtttctgttcccagagtacttgtgattagaagcggaagtctgtttttgctgaatagggctatcttacgagaggtgattcaacctggttatcaaaggcagcgtcaataaagcactgcgaaaaatagaagcatggtctgtcggtaaactataggactctgtcttttacttgaagccaagaacaaacgaaaaggggcgctggctcacccctgtcgcatgccttgtgcttctgtgcaaatgtacattcgcgttcacgggaaggcacgcacgagatgactggtttgatccttcaatgtctcgaagtacattacacaaacacaacatatgaacagaagagtaccatcacatgcagagctgtatctcttgttttcatgaggatggaatgcatgtccagctcggaagtgaatggcgctcgattttacgactgttcagcgctaccccaaacttcaaagttgccagattgacttgctgccttcacatgcttagaaggatgaccagccatgaatgcagcaaggcttctagtccttgtccgagataccggcattactgactgcccttctgggactttcgatgaatttggtcaatgcggtgggagcactgtgctactaagttcatttactgaaaccgccttggctccaatatttggagtacaaactgagcaagatctcgagcatgtttatgtgctgcagtgaacgtctgagctttctgcttttgcgctctttttgttattggctacacccaacaggagggaccgtattctagctgtgctgtgttctgctgtgaagctcagttgtacgctcgatcaagtacactcttgcagaaccttggaacgaaaggactcgcgcctatactattgggtgctttgcgcctctatcataagcaagccacctatggcgttgagcacctatataacctagtctaatccacgcctatggtgttcggcaacgagttcgattttcaagacagtgcgtttctcgctttgcctggtaccgggatcaattccgctgtagtgtaacgtagtgtccgtatcccttgcttagtcatatacagcaccaacgagaaagagctctcatttctgtcgcctcgtacttgtcccgctacattagaagctcgtgccgatacagcttgagtggtgacaagggcgccaacgaggacaacgacgggtgacaaacacctttgacctgaatgacacatgtaacgacgaggacctatattgatcgttgtctcacgatggatcatatcaatgcatgttcaacaatgggtgcggcctgggaaccggagccgggggtatgtccgcggaccaacttaaataggacgcgttctctcggattcgttttgtcgccatcactctcctataaccaacctctcaccttcaagtcatggccagccgcaccacctatctcgccatcttggcaactatcgccctgttcctggctaccgcgaacgcctaccctgtccaggatcccagcaacatttgtgcctctagacccggcggctgccctccccctattatcaccagagaagacgttgaaccccagggtgtgtgcgacagacgacctgccggctgcccccctcgtctcgatatctaagcaagctccggttctatctctggattgcctttcagcagaaacaagcctgaccctcattattaaactcatcatttttcgtggtggaacttgtcattcatgttactttttaattatgcggccccctgcggttctcatgacctccttcctctacatacgcattcgggacatactgtgggcctctataatttccagaaccttgcatatcgtccctgtaatccttcagcgcattatgtgtctgcaccgtccgataggcgtactgctgaggtccagaacctggttttgagggcggtggagacacataacctgctgtcattggatcagtcgcatagatgggtcctgccgctgattctgtcaagggcactggcaccgcagtgtctccgtcgtcgccccgtcgatcaatcttggcttcatactggtgaggtgaatccagagtcgttaaggataggtggtctctcgatccagctttttgccgattctttcgccgcatgcaaaagaaaacgcttccagcaatggcgatgatggcgatacttccagcaaccccgccgataatcgcgccagtgttgctcgcgccttccttctcacctggggtcgtggaagcggtaggcgaaggtgtcacgattggcgtgaagcgagttacgaactggttggtgttcaagtcataaacgattgctgccttggacactgtcgctacattatcctgacctgaatatgcaaggacgtggtcattagttggcataatattcttcaaggcccgcagcggttggaggtgggggttcttgatgccgcttgaacgctcaggatcacttgcttacctccccatgcaatgaacgttgatccaacgatagtgcaggctggatacgtccttgggctgatatatgttgggccctggatccatgtcaaagtgctgaggtccaaaacgtaaagctcgccgttggtgaccatatttgttcctgaataagcccggcctccgaatacaacgagctttgatccgtcatcggctaataaaacaaaaacgatggtcaaggtcaggtctcgtgtaacggagcaaacatcaaacagcttgcactcctttttttcctcatgtttgcgtgtcatcaaatctttaccaatttccatgcaaaaatcagcacggccacctggtgctgtgccttttgtaatctatgtttagggatgtgtgggcagatggtgagccatgacagatgcgcagcaccgcttatgttttctttcagagcattaaggattacgaaccagagttgcccatgtgttcgtgcgtggtgtgtactgaacaaggccgccaggcactcccgtgctcgtgccatacgcgtaccctccaaagtagatgatgctctggctgcgtgcccaccatacacctttgtaataccttcggtttacaagaccctgtgggggcatggcgagttgtgttaaagagtctgagtcaaagtggtagacaagcatatccgtaagaaccgagtcgttttgaggaaaccctcccgcaagatacactgagctggacgttggatctgtgacgccgtagatgccctcgagtgtaggattgggcactgtaatctgagaggacctccacaagtccttagcgacatcgtacagccacgaaaaagccggttcgcccgtgcggaaggtcgccatggttttgccgtcccctgacatgaccgctgaaaacatgcgttgtcggggaccgctgctcaagccgtgccagctggggttggcggcatcccagggcaccgacaggtccagggaaatgaactggttgtagctgttctgaagctgtaggttgctgctgtaggccccgccggtgatatacagagtattgccccagcgtgccgaggccggtgcagttagagggatagggtcagtctggctcaacgctggcactgccaggtccagcacaacaaatatggagagtaagctgagggcatgcagtgaagggaacatgaggtgaatggggtcggagggcggaagacaagatgcggaatcggcattgccacttgcccgccatccttgtcccctccatcgttgctagctcccttgcgtgcgccccctgcctcttcgtgctaagctagttctgtctgcctgcagcacccctcggtgtcggtgtgtgaaatcacgaacctttttcatcccttcatacagccccagcccagtctgcacctttggcagcgtcaggcactttagatgcgggtgcatgtctgagcactttgttgactttggcccctcgagaacggaaagaaagcgctcaacaagacgatagatgctgtacatgtacgtgtactttgatcggcgatgtttccttgtattcagcactcagccgcgctacctcaaacaacttacttgcataaccatactctgtggcaaccctagcacaggtgattcggagcacacgtaagttctgtagctcctcttcctcgtgctattaacctcgcacttgacaccggcgaaggagcgtcttcccaggggtaagccctattggctactttgggttggaggtaacggggcctccttggctgctccaggtgctctcgatccatgacatgttctacgaagtccacttgaaacgtaatgctcatggtacacaagatggatcgaaggcgaaaaaattgagatttgatttttttgttcctttgttccttcccctctcaccattccatctcctgttctcccttttggtgcactcatatcctcagtagagtcgccatattcccacaaagcatcttggaaagtgtgggtgcgttcaatgcattcttttaagatatttcttgccttcaaccctcgtgctttccctgccgcaatccttctgagctgtctctgcttttaacaaaacgcgattcccggaactatagcacaagtgcgatgcgcagcactattttcgttgctggagaggcaaagcgtggaagaggttagtagcacggtgtctaacatcgtatatttccagcttgctcttttgagggggatcaagccgaccaattgaagcgtgattggcgtagctccgtattactcacaagtaaggacctgcggtggttcggcctgaggtaggagctgggagcggagctactgagcagcaaaagcgccataaacaccatgttgatcctcacatgcttgtagataacttgccctggcatcgaacagtcgtctacaaacacaccattcctgtaccatcttagaccggcaggatcgcacatcgcttctggagaacgctttctcgtttgcctctctccaggtattgcaaggaccataataggcaccatttggtttagccatgggtacttttacagccgctaacatgatctctgcatatactttatgaataccttgtggccacaccgatgattttgtctgtgttgtgttttcgccaagcggcaagcagcttgcctcgggtagcgacgattgcacggtgcggctctgggacgcagaaaccagtgcgcttggtgtcatcatgagcggccacaccgaacgggttagaagcgtggtgttttcgccaagcggccgacaaattgcctcgggcagtgacgacaaaacgatgcggctttgggatgtcgaaacaggactttatgtggccactataaatgactcttatgcagaggtcatgtcagtcgcatggaacgctggtaccaacgacagctacttatcgaccgggtgtaccgataaatccgttcgcatgtggaaggttgaggaaacccgtcagcccgtgactgtgcgcctagtctggagctcttgtcatgaccagcttgtggtgtcagatgccaaaatcttgaacgcgcagggtttgagtagtactaatatgaaattgttggaacaacgcggcgccattagcaaacggagttctttggaagagcagaagttgtagacggtttaaacaccataaaacccacaatgcagtgaatataaatgtccctacgatcttaccaatttaagtgctgatagtataatgctgtgtagccggggcacgctctatggcgatgcgggctgaaccgaacgcaaatttgaggcgccggactacacgctcatcagacaccacgaaaggtgtcagttcatctagacagcaggacggtggccatgaaagtcggaatccgctaaggagtgtgtagcagagccaacagtgtagccatcttgcagggactgtgcgacgaagacgccgcagtctacgacgctataactaattcgactgcttcagaaacgtgtctcgatgatggacgtgcgctgctggttcccaagattacgcctttattgaggcaactgtgctttcatatgtgccttgacaaagcaaggtatcgaaatagagaaaacagcgtctcttgtcaggcgttttaatcagtcgtctcacgctaccaattccgaggcgtatacgtcgcgtaaaaagcatggacaggcgtagaaatataacaacccatgcgtccagctccgctccgatgcgcccgctctctacgacccctacagttgacccgattcacgatcgctttcgtcatcatataaatgacagcagctctccccgtttggatttccctacagccctatgtcctcttcaatcgtcaactcccaaaaaactctagggatgactgcaaaagaacaactttaatgcattataggtaagttggcatgcggccctcctaattcgtgatgcggctcacaatcgacgtaagaatcaggaacaaactgcaagcgcccaagggtgtcggtcgatgcccttgctactggcgcgggcagcggagagctgggccagtattgatagacgatattgtcgctttgaacctgaaccggccggtacggtaattgatatttgcctgcagctgtctcgctaacgcccagacgctgttctgtggtgaaggttggctgtggcactgcatatgctgggaacggtaccgcaggggcaaaatatccagaatcaccgcttgcactgtttctgttgccatgaggctcctcaaatttgccgccatagcttcccgtggaggtcaggccgttattgtccaagatcggcgtgctgttctgacctcgtcgtcgtttaaaataaaaaaacgccccaatcagcagcccgacaacgactaggccagcagcgatagctccaatgatcactccgagattggtggaaccgttggacgcagggctggaagggttcagaacagcacctgttggcttgtactgagagacatacttgtccgtgttcatatcatagattacggcagtggtagatgccgtacctccatcgtcctgacctgattgtttgtgggagcaatactttcagtagatgaaagaagatttcgaacgttctttcatttgatcgctggtttccttacctccccaagcaacaaacgaggagcctgcgatagtgcaggcagccgaactgcgcggagagagagaactggtgccttctttccaggccaaagtattcaggtccagtatgtacagcctcttcgaattgacaagagctctacgacccagtaccctgcctccgaacacaatgactttcgagccatcctcagctaagatgccaaaggcagagagaataaaaaaataacatctgagaaacggggcgactgcattgcatcctagcataggcgtgtacaccccaactgaagtttgaactctttacaaatctccatgcagaaatctcgtctaggaaaaggtgctcgtcctgacgtcgactgcattagaggaagagagtatgaaatgcccagttagtgcagggacgacccaccacaataaaacatgatctgagtcaacaaggcgctataccacagttgtccaggcgcctgtacttggtgtaaactgggttaaagcgcttgatacgttgttcaccgacgggtagatgtagcccccaaagtagaggatactctttgtctgaggccaccacacgcctctgtaatacaatgtgttcacgaagctactaggagacaacgcgtatgtgtttgtcaagtccgtgtcaaagcgatagaccagcatctgatccagagtcttggcttcgtatcctcctgcaaggtagacaaggttggttgtgggatctgtcactgcaaaagccccttgtaaagatgggttgggaaccttgatactagaataagaccagtcgttggatgtggtgttgtacagccagcaaaagtgagcaccccccgagtgaaaggtcgccattgtatgtttgtccgatgaaaatgcggcagagaatagaacttgagacgggccttgctgcaaaacatttagggctggcttgtccgcatcccaggcgaccgagagatccaaggcaaggagctgattctggtatgaggaatacgtttggttatcgagaacagcaccgcccgaaatataaagttttgatccagcgcgagcgaacgctgcacccgagactggtatctgggcttgagttgcggtcagcaagatcgcactgaaaatcgcgaaacggtagctgacagctgctgccgctgagactgactttgattgacggaccatggcgattgagttggggaatgggtgtctgatcaagatgcaaatgttggatcccttgtgaatccctttccaacccgcacgcagaacaccctaccgccttatttgtgcgtttctgtcaatagggattggccctggcgttccatacgcctggactcagacgccagaaatcgaactggccatagccagccttcccacagctcacacctccactcacgcggcgtcagactcttgattgcaggttcccggggtgtcgaggcccgtggagactctcgctgtggatctctttactttatttgcttaaatgactgcctgtggacccctgacttcctctgctcccttgccgtgcccatcggcgcccaatgaatgcaccggatcgctatgagggcttctagcttttcctgacgtgggtacatagagctgcggccctgatgctggtattgacgtcaatgtcagcgacgttgctgaaggcgtttgtttgccgaaaattctggtggccacagacgttgcgtcctgcgactgacgctgttcagaggactccatcggtacccttcggtacacgctgtcattctctggaccgcaatcactgtcgctgcggctacctcgtcgtcttaagaagataaatactccaacggataaggcgataatactcaaactgccaatgacgcctcccagaatcgcgcccaagttttgaggctgcttgttattagtctctggcttggttactgggttggtaaccggagccacatctacacgagtctcaactggcatgaagcgggtgatgtactcgtttttgttgatgtcgtacaacaccggcgcaagcggtgctgtcgtccggtcatcttgtcctacattgtcacacagctttgacagttagcattgctgatcagggtggcaagaaagaaaaagcgcgattgcatcaacaagggacaagaaaaaggcataccgccccatgagataaaagttgatccaacgatggtgcatgcggaaaatgtgcgtgtgctggaaaaactttgtcctttggaccacgtcaaggtattcaggtccagcacgaaaagctcgttggtgagtttccaaaccggacccacgaaagctctacctccaaaaacaacgagtttggatccgtcctcggcttgtaaaaaagagttaggaacaatcgggctgcttgctggcgcatcaggtactgaaaacaaatccacccttacttacaaatgtccatgcaaaagtccgctcgccctgaaggtccggggtttgttgtagtctaggctcacagaaaatgaatgacagcagaaataagcaatgtggtgttgtgatggggcgaacagaaagcaccagtccttcagcaggcaaaagcgtaccagttgcgaccatgtgtttgtgctcggggtgtattgcacaatggccggcggcgccagcactgtcgagggatagttataccctccataataaagaatgctctttccccttggccaccaagcggccttatagtgccaccggttcacaagtccattcgggggcatagtagttacggttgtggtgtcagagctgaagtgatagatgagcattgaagtaagggtgtcgttgttggtgttgtcgtatcctccggggacgtaaaccagacctgttgtggggtctgtcacaccataaagaccagccattttcgtcggcacggtgattttggagaaggtccaggagtcgccgtcaacattgtacagccaagcaaacgactgttctcctccgaggaaggtgaccatggttttgccatcaccagagatagcgcccggggaattggtgccggaaggaccactgcgcaagagctgacaggcaggcgacgatgcctcccatttgactgcgaggtccagataaaagaactgggaggtgctgttcatgtagtttgtgttggtggaatagcctccccctgagatgtagagttttgtgccatagcgggcgtatgctggaccggtgacggagaccacgctatcctgaccgtagacaggggccactgcgaccgtcaggaacaagaggggcgagagcaccgaggcagctagagcagttggccgcatgggggtggaatggagctgggcgggagatggatcagaggggtgttgatggtagcaatcagaatgagaagaggcggcaactcattctcggctctttcatatagtcctcaccaacctaccaacccccgggctctggacaggcacgcagcaaggttcaccctcatgtggcaggcacagaggaggctgaaaagtcactttggtgggctgcaaggctcccatttcgagtgtcgatcccttcgtcaatacaaacaaacagggctgagccgtgcccaagggtccggagcacactgttgttgtacgagcatgtgggacgacgacatgcaccgcccttgcctctaccgaccgaccatgccactttggctagagaaacgagggcatggagtttcgcgaaaatcttaacttttttttaccgcctgaatcactgcttctttaccgagcatatgcagagcgaccgttggcgaaccctcgtcttgagggctcctgcgaaagtagaggctcagtgcccctgtctcccacaaatgggaggaaggttgcttgaggacggtattccgacagttttcctaagctctttgttgaatctaatcagggaccaggttgaaaaaagtcaagcgcatgatctcatccatcaagttctgacatccaatacgggtgacacaaatagaaatcgccaaaaaaaaaaaaaaaaaaaaaaaaaaacattatggaagcttgagaacacccttgccttttggaaaacagcaacctatacggatacctggcctccaatgataccatcggtcgtgttactcgtcctgagcatggtctctgcttgagaatatcgctgggcgtaatatgtagtcctggaatgcagcgatgatgctctcgggcttgataccaggaaggtcgtaaatgtggttcgcaagaacaactacctcctacatggcattgatggcacctagacagcatacgatccatttctagccgtcaatttaatccctcattacctggcatcggtagcacaacgagatagattctccttggccggctccaggaagcatctatgtcaagttttcataggtcaatgctgcagcagtcttttttcttcagcctgagatttcaacagcgtgcacatcgtactttgtggcaggcttcgaaattaaggtgggaagtaatataatgagtaatttctgcgagcatctaatgaacatagaaggactatagcaatctgttgatctacagtccaccttccttaccacctcaaagaactgttcgaccatagagaccgtggagatgagatccttgggcgtgccgtcgatcaaatccaccatcgtgccgccataacgacaagtaaactctcgaagttctgtgatcacggcctcgtgcgcctcaagaccccattccgaattccggtgctgcttttcctctgcatcagtggcattctcaaacggatgcaccaacgcccagcagattggattctctggcacgctgcccacactccactaagtgcaggcgaaacagaaaaggaagcgagacggttaatgatgcgggactttgatgcgtttgtattgcgcgagcatgaagaagtattggagataaaccctcttcattgcattcttaccaagcgcctgtttccgccgacgacattgcttaggtgcgagaagggtgcttgcagctgcgggcacttgaaaggatccttcggaattgccacaccaaccatgcacatagaagggctgaggggcttttggcgtcggaactttccgacgccccttcgacctgaagatgtgtatacatactttttcggactccactgttggctccgtcagcgccaacgaggatatcatcattatgatggaccgtccgcgcaatgcatctacaccttgttgttcttctcttcgctggggagaatgtgcttgccaaagtgaacttcgccctatggggtctgtttagaggcaactcgtgtatcctgggtcaagcttatatcaggttttcaaaaccagtgctgcaaatggataaatgtgatgcgtagccgtagtatcagtccaggctagagagatgtccgagaataccaacatccaatgtaaacatacagcttcttttgttccttcacttcaaaggtacccgacgtctcaagcgaatgattgtagatgactaccttggataaagaccgacatattttctcaatctcctctaagaggcctagctgctcaaatagcggcaggaagttgagacctacggatactgcagatcttgcagcagtagtaagcagttgcaagtcgtgacaggacgggtcagatcaaagagttgttacgcacttgcgttttatagagtatgatccgcgtacttagaggcttgacctgcaaagcctgctcgaacactgcgtagtgaataccagcccgctccgagagtgttcggagcatcaagcttcgaaggcctgccccaaaaatggtgaccgtaggtgacctagtgcctgttgcttgtgccagtatcatggttgtttgcgcttctggttttttaagtcccgcgcagcttgtagtgcttggtgaagaagtgtcgcgaatcgtaggagtgttgaatcagctaaactactaagagaaaagaatttgacagacacctttgctgtgcttccctccgcagatgccagattgcgtgcgacaggatgcacaagacgcttccaatatcgtagcattacacaatagctcgaacctcactcctgtgtcgctgtccgaaggcaattcggtggtggaagcggctcgtttacaggcgctttaggttcgccatcgaaagaccttgaggctgacggcgctcgttccctctctatcctctcctcacccacccttcccctcgcgttctgccttacgcgatagtcaacttaagattgtgcaccgcattcaggcacgtcggccgttcaaaaaaaaaagagtcgcctggctggtggcttccatgttttcaattgcaggcttactgcgccactgaaccgagtccaaggactccaagcaaagtcaagatgcgtttggacgaacaatcactctctctggagaagcaatcacatcgccaagagaccgccatcgcacaaggaacatcatgccgcccaagaagctgacgggagagaagaagaagattgtcgaggacaagacctttggtctcaagaacaagaacaagtctgccaaagtcggtcgctatgtcgagaccgtcaagaaccaggccatgcacgctggccagtctaggaaagacatggtaaagtcatcctccattgctcttcttctcgccttgaatccctgcctcttcactctgcagaggtgtagtgtctgactgtagctactcttttctctcgatttatccacctttcgcctacatggacttttctgcaccatcctctggcgactgaacaactttcaccatcaatctggaccgttcggttgtctcgcaacaaaacttttctttttttccgacaacaactcaacctcttgacggcggtgattgagaatagattgagaaggaccgcgagaagcaggccatcatcgatcgtaagcgcgctgagcaggccaagaaggaggagctcgttgacttgttcaaacccatccaggtccagcagaaggttcctttcggtgtcaacccaaagaccatcctgtgcgccttccacaaggccggtacatgcacaaagggtgacaaatgcaaattctcacacgacctcaatgtcgagcgcaagactgtcaagagggatctgtacactgacaaccgtgacgacgagaagaagaacggtatgtgttttgatgcacctcttctcaaggacctaccatggaaagatcaacgaagcaagtgaaaattcaagcccctaacaccttgaaccttccatactactgtagataccatggataagtgggaccaacagaagttggagtctgtcgtcagctcgaaggcaaagggaggaaaccctgcagtcaccaccaccgacatcgtgtgcaaattcttcttggaggctattgagaaccaaaagtacggctggttctgggactgccccaacggaggtatgagcagtggatttatggaactgatcagtcgaatctggcggctctaggctacccattaatgacgatctcgtaactcatcacttatgaacactgcatctttgtaggaactcaatgcaaataccgccacgctttgcctcctggtttcgtgttgaagaccaaggccgagttgagagctgaggcaaacaaggaagtcgtgtcgatcgaggactttttggagaaggagcgtcataaactgggcaagaaccttacccctgtcacagtggagacgtttgctgcttggaaaaagactcgcgctgaccgtatcgaacaggaggagcaggccaagcgcaaggccaaggaggccgcttacaaggccggaaagatgctgcagttctctggaagggaactgttcgacttcaaccccgagatcgctggcgcggacgaggacgacgatggagacgacgtcttcgacttttccaaatatgctaggaacatggatgcggatgagacaccggaagagttggaggcacggattacaaaggatatggcgggtgttacagtcgatgacgagctctttgctggtgaggaggatgttgaggtcagcgatgatgacgagtaatgtaccgagggtgcgatgaaagaacagagcggcgtgtagtttagaggtcttgagtgtgataggcattggatgggcatagataacccttgcgtaaccaagcaatgaaaagcatttttttttttatttcgcacatcatggacgaatctcacggtgtgcaggacggtgccttaaaaatatgcaattttcaatcacacatctgtcctctttcttcttttgtacttctccacattcccttttccccacatttttgcaatcaataattgctagacagaacgatgtcaagaccagagataattcttcaccactaccagggtatgagtaaagggttatcaccaacagcggcactcctgagcctttcaatcttctcacgttcaatacggcttgtctgctttgatatcaacaggttcaccctatgccgaaaaggtggttgctgcccttcgggtcaggggcattccttggtgctcggtctctactagcgcaatgctcccaaggccgtaagtcacttgtaacattctaccgtcgaacagtagcaataggcgaggtctgaagttgcattcgcctgtgttaagacctcgtttttcttacctgtgcatctactagtttactcgaacccctggcccatggctacaggcgcattccggtgatgcagattgacaacaatatttattgcgacactgccgtcattcttgaggagctgcaaagacggtacccgagtcctcaccaggcagatgtcgctgtagaagacatgatttccagctgggtggatgtaggtggatatttttgcgctttgtacaaattttttttgatcgagcgaatcgggtccttgatcgcgcagctcgaatttgtaaatctttttgaccctgtgctacaaaacaacactaaccctcttgcctccctaatagaagcaattgttcaacaacgttagggaccagatgccatggggcgctactaaggaggagcaaaaggctagcccgctgcatgctgtctttggtaacccagctttcctcgccgacagatcccagctgaccggcggccgtccgatcaacacggaagctattcgcaaagcccagccgtttttgttggaccagctgctcgccaacttggattctctcgagaacgccctgcgttcgtcctcggctcgctcaaagtcaccgtcgtcagtgagtcctcggtcggaaggcggatgggttatgggcactcaagcgccctctgatgctgactgcagtgtctacgggattctctggtggctcatgacgaccaagcgtgctcccgagtacgtgacagaggaagcgtaccccggtgtttttgcgtggtacaatcggatgaatgcttacatgaagaggtatcgccatgccacgctggaccgagtgaagttgtcaggagaggacgccttgcaaattgcgcgatcggcgtcaactagtgcaaacagtggatttactagacttgaggatggtgcgcatcctgccgaaaagcgaaaggcaggagaggtcgtcagtgtcacgcccaacgactacggaaaggtgcctgtggtgggaaagatccttcagatcacccgccatcgtgtcaccatcctccccgagccgttgaacagtcatcccgacatcaaggtcatcatgcactttcccagggccggctatgtcattgctcccatgagcaaggcttcactttagagtatgagatgcaacaactactcgttaaatctagtatacaacaagagttctccatctcgatggccagcacagttgtgctacattgtatcttgcggctctgcctgtcgtcaagattcctgccgatttcgcgccaagtaaaaaaaataaatgaatgaaaaccgttacctgttttcggtatgtgttatggacgttcagtatcagtcgttgacggggtcggacatgtcgttacgttccttgtcattgttggacttgaggttcttatcctgattcctgccgtgttaaatgagctacggtgttgcttctccgtggcaagcagggcgtgcaattacggagcttttttttttggtactgtaactacgatccccggaggcatgattggggggcgactctaaactgtgttggactaggccgttagttgagaagccacggctcgcccgttactgtcgcgcctgcctgcgccggccagcatccctccttgtccataaccccagacgcatgaacggccggacccgtcctctacgtgacctgttgggggcgtgcaatttttttttttttttttttttttataacaatattttactaaccgaagggtaggccgaaagttcctgactatagaatgaactagacgaagaaaggtccctgctgccacggagtggcagctatcagcaactaaacgttcggaagttcacgtccccaaatgggttccgtttgggggcgtgcaattacggagcttataattgtgcatatatggaaaaacatgcacctatggagcgtagcccatacaccgtcagtgccttcaataactcatctatcaaagcaaatgcagccgacgaaaacacgcaagcttgaaagagctttccttggcttccgtggcgcaattggttagcgcgtctgactgttaatcaggaggttggtggttcaagcccacccgggagcgtatgcttttgcttcttgcgacgattttaaggttctgtcgctctcgttttgactagtcaccagttccggaagtcgctcgctcatttgagacggtaaactctctttgcagcatatgattttattgattgttcctaaagcgttttttcaagaggacggcaacctggtctgaccacgtagcatgcgcttgatctgtgcaaccgcatcgctgggctgacgttaagcggggaagaaatcgttgagaaatatttttagtacggagaactttcattgcccaggccgcgatgttagaatactccgtggcggttacctgaatccaaggggtcgatgatccgcttgtggacgaggtttcggcaccatgctttgcgcggttagcagctaccactgtctcatagaggatcagccatccttccttgtggtcctgatcatatgacgaattgatccaatagcagtaccacttgtgcgactgaaccacgtcgaaagcagtatcatcctcgttctctagttccatcccatcatcctcggtgttgctgtcatgggtagtcgttgctggttgtagtcccatgctggaaatgaaagtgcactgtgtgtggcatgcttgacaagagagcaccccttgcttttctacggtagtccagccaaagagtgataggatcaagggctttgtgctgggtccattctggaatgactttgccaatgcctgtagttgctctacagactaaaagatatcgtggtatagaagaggcgtgtcagtttttgttacatggcctgtcataaattttttaacaattgccaggagatacgacgcgtttccataccaaagggtggcgaactgcattgaccaaaggatccgagacaatcgactcgagtcgctgtgcccgatccaacaaatcctgcctagcctgagattgtgacacaaccgggaatttgtaaatgttgtctaacaatagtgagattgaggcatgagtgttacattccgcaacaacatgcaaccttcctttgcgcgtgcgaaagcagtacggcattaccatcgcaaggatgcgtcttccatgggcacggtgtaacgtggttctcggtaagcatggcgtgaaactttggtcccaagactataatgacagacacaactcccgcgtcagcctccttgcagtcccaaggtaacggctggatcatcaaggaatggcaacacacataggctagagtgcagtatcctaccttcaatatcctgctcggacataaagtcatctacatcaaagtcaaagtcgcttttgacggctgcactggagctcccatcattgccgtcagtgtccgcaacatcctgtctcctggcagcatcggactccaggtcgatcctgacaatgactacacctccgcaacctccacagcactccagtcgatcgtcgctcgtgttgatccagccacgcttggcacactcgactgcattgaccattttaggtttgtcaaaccaggtcgagggcttgaacgtccctagtcgctcatgaaactgatctcttgaccatggcatgtatcgtttcctggctgcctcctttttctgaaccgatgttgcatccgagatctgcgtcccgggtccagtggattctgtgggcgtggcagggacgaactgagtggtgggagcactggcagcaatagacgctgcgatagagtcatgtaaagttgggcgcgaggccgctaggcgggacagtttgtcgagaatggcgggtcttggaggcttgtaggactgcctccgcgcagcgataagcagggctttgttcgtaggaggcgacgggatcgcggaggatggtgaggatggggacgcattgctgaatggtggggtcggcttctcggcagagtgcctcttggaaggatgggcaaagagcgagttgagcagtgcgatggactcgtcgaccttgcgtttggtgtccatggggcagcgtaggggggttgatcagatgctgtccgttctattgcgtggctgttccaatgtgtccgtggttggcgtgattgtgcggttgctcctaatcgtccgtgtctggcgtagtaacaacagtgggttgtctggagaagaacagagaagaaccgcacagggtgacgtgcttttctgtcttcttttggcccctttgcctggacatacgcatcccacccaccaataatgggccgtgtttgcttgccgcgtgggaggttctgatcagatatctataattgcacacaccacccaagccaagcttgttgggttcacttttttttttgtcctctgcctttcagttcacacctcacaccttccttttgctggctcctcatcacacctcctcttcctccactcctcctcctcctcagttcatcccccatcatggacgagtttgcggaactggatcgcgaaaagctcggctatgacaagtcaaactccatcgccatcattatcggcctgaccttcatggtcctcttccgtttcatcggttatcttgctgcaaagcctcccaaggtcgcagccatcggcaagaagagcttctgcatcgtggttctcggcgacgtgggacacagccctcgaatgctgctgcatgcgcggagtgcgctaagcgccggctggagagttgactttattggttacaaaggtaagccaactgatcagcattctattatgtttgtttgtttgcctgcttgcttggttgcctcggcctcgcagtgttgaaagaaaaaatttagcagaaatgtctattgaggtcgcctgtcgagaatggctatctcttgcatgcacagtctgcccgactactatacgtatattctgaccatccccctttgtcatttcaaaccaacaacctcaggttcaagcctaccagaggacctcgagaaccacccctcgatccagttccattacctcactcaacttccccgtgtgtccgagagcatgccccgcattttgtactacctctttgctccgatcaaggctttgctcttggcttcccagctgttctatgtttctatgttcaatgtctctgctcccgaggtgtatctagttcaggtaagaagggcaactgactcactttttattttttttttggcttgctgacaaaccattcgtatcgaaaatcgactgggatcttcgtctaaccttcctcgcacaaaatataaaccttgcatcgtcttagaaccctcccgctatccccacgctccatgtcatgcaaatcgtcaactggctcaagcagcgccatttggtcattgattggcacaactatggctcgtcagtcgttgctcagcgcttgggaagggactctgtcttcacaaagttggtcgctttctacgagcggatgtggggttacaaggccaccatccacatctgtgtcagtcgcgccatggcccgtgaactcctctacaagttcgagaagcgtggaaaggtcgccaccctctacgaccgtcctcccgagcagttccaccgcttggagacggatgagattcacgaggtatgacattgtaggatctgcacgagtgcctcattctgctcctgttcgtttagctaacatactttggtgttatgcccgcgtccatatagtttcttggagagctgaagctggaaaagttggtcaaggagcagtctttaaacagctccttcttgcccaccattggaagcaaccagacgttgttgacggaaaagaaaactgtcaacggaccagcaacgttccgtggcgatcgccctattttaatcgtgtcaagcaccagctggactgcagatgaggatttccagttgctcctgaccgccgccaagcagtacgacgacctcgccaaactcgagaacacaggcaagtccacctccactggaaagggcaaggccgacgtgttccccaagttgttgtttgtcattacaggaaagggccctttgaagcagcactacgaagaggtcatcagcaaaatggatctggagaacgtcgtctttgttaccacttggctcagccccgaaaactacccacgccttctcggtatgttgcccatttttcactcattgcatgcgaacgaacggggcgtgtgctgcgctttttctttttatcctcacgatggactaagcgaaactctgttgttcttgttgcactgattaggatcggctgacttgggagtttcattacacacatctgcctccggcgtggacctgcccatgaaggtcgttgatatgtttggctgcggtcttcccgtctgtgcattcaactacccggcgcttcctgagctggtcgtcgcaaagtccaatggcttggtgtttgagaatgccaacgaattcaaatctcagttggtccatctcttcaaggacttccctctggcccagcccgagagtcatcagcagctccaggggatgaggacagtgatccgggactctttccagtcaacgaggtgggagcagaactggaccacgaccatgtttccccttcttcgtaacctggacaagacctgggcagactcgcagatgtttgcggagaacccggtgtacactctcaacgctaagcaggcgtcagcacctctggatattgatgagctcgtggaggatgaggaagacgagtacattgacgatgaggccgaggccgaagagtagttagtcgtagccaacgcacgacagagagtcgcattcattcccgccccccaccactttttcctcatacatttcttttgtcccttcactgtctaatatattttctccccgatcagctggagtatccacatgcgacgttttaacacacacaatgagagaacgaaacgattcacctgcttccttcatgccgtaaaatgtgaccattcaagaaatttactaagaaatacttttaaatacatgtgggtacctgccccaggacgcttcgtgaaccatcgatgcgctatagtggtctctatatatgtcgttttcagcattagagaaatagcccttttagggctcgaggacgtggtccagaacagctttgaacgcctcccaggtctccttgccactgggaacgatctgactggccggaagcgagaagccgtagtgaccagtatcacgcaattcgaccgcgaacggagccttgacaccaacactgaatgcatagtccgtagagctgccggaggcctggtaaatagtgttgtaaatatctccggccttgaagcgaacaccgttcactttttgcaaggctgtgacggctccatcggcgagacgcttgaggtagtcgtaattgtcgggcaccgtgccggtgtagccgtagggaaccatccacaactgagagtacgcatggaaatcgactaaaacattcgagaaagagaattagacaaattcagtcaaggccggcctatgatgtgcaggtggtacctcgggcagcagagacggggcagcgctgggtaagaacttactgtagctcacgacattgggggtgtccttgaggtacttgccaatgttggcggcctcaggggaagagaacgcttgtgggcccatgtagtcatcggcgcaaacatcgtttgaggagccaccttcgttccagtgaaagtcccagttacggttggctaaaagggcaaaagaagagaggaggacagattgttagagaccaagaatttgatattcaaagaaaaaaaaactgaacacacgatagttgaacatactgtcagtgccgagacagtctgggtttccctcgtttggctgagtgttcttgcgatgcatacggtcctttgtttgagtgacgacgaagccatcggggttcatgatggggatgatgtggaaggtaaacgtcttcaggtactcggccactttagagtccgtgccggttaccagctggtcgatgatgtactcgacgacagcaccgctgatccactcacgtgcgtgttgaagacctatttttttttttttttttttttttttcgttttgggaaagtgagatggttaaacaacatgtctcgcttatagcgtcgtcatttgtcgtcttttacatcaaggatccttaccatggagaacaacgttattggggcctttgccaatcttgatgccggcctgttcccttccttcataggtctttccggcgctgaacccagtagcaatgtctgaatggttcttgatttgcgcgttaagccacgcggtatgatcgtcgtaggaatggtaacctgcaaaccaatcatcggcattcgggactggggtatggccaccaggtctgcggatcaaagctccaccaatttcatggaaagtctcgaccatggtcttcttgatggccatccacttttgctggtactggttatactcgtccttctcaacattcagcagctgttgcaagttgtcgatcaagatctcgtatgagaaaccgagggccttgaacttttcaaaggactcggggggcacacggacgtcaatggcaccacccaagattttgttgtgtgagaagtagtcgagtccaagctggcgctcgacttcggtcagtttctggagctgggccttggttttgagctggatacgaactacgcggtgatggtcataggatttaggggtggggtcggctcgtggctgcaggtgagggcgacggtcaataggagcggggaacgacctgggagagagacccttggagggaggaagaaaactgcgaggattgcggtttagaggggcagcgggaagagccgtcgtggtgcttgagtctgagaggaggatcgacaaggccactacggccgtcagcgagatttcggtgagcgataaacgcatagtgatttggccttgaaacttttttttctgggtagggaaatggttggatggcgaggattgcaaacaatagcaaaaaactgggcaacgtctgaaaactgtcctttataagtctttcttgtccatgggatcgctcgctcgacaggcacgagaggagaggaggaggagggggaggggcgggggatacgcttcgtcctccttcgtcctgtgatacatccgtgccatgtctctctattttccctggcgtgtctctcacagaccccctgctcaatttcaatccgcgacagtcgcaaacccctgtgctcgtcttgatttgtccacatggaccctggacgggggataataacaagtcttagcgtcattcctaaatccgtttgcggtctccttgaccgtaaattgctcacaaggaagcaaaacaaagcgcatcagcatttgcttacagccatacaaatcttgcgcgaattacgaggtgttctcactttagtgtcattctcaaagccgttacctcaatcattggacaagcagttcgagcgccagaaactcgttgttttgcaaacagggaaccgcaagtccaatgcgtcctcgagccggcagtataggatcaaggtattatacatccaatagcccgctaaaatgacaggaatgttgtcgttgtgggaaaaaatccactgtgttgtgtcaaacggtgagagggtgataatacctgctgcgagaagtacggcgacagccaagtgctgcatgtgcaatattcctgcactgagagatacctcattggcttgagaaactacatgcaacgccagctacgccatccaatgcatgtacgctattagcgtaaccgagtaaggcgtcattcaagcatttcattttcaattgcgggtcaagcagatcctctcacgcgccctcgtgagaaggtgcaagccgatcccatccaaaaggcgctttttttcacgggaactcatacagttagctgtcaccaaacctccttgagccgttgtcaggaagaacggtcgcccatgctttgcatcattctgtcgctatgtagcaggacggcgacccagggatttgatgcaccttgtctgatatcattgtgctcttgaaagaaattgcttatagaaggcattacggactagttcaggtacccttgccatgtaacccatacatgtgttcagatcgacccaatatatgtatagagccgattacccttgctgggcatcaaagcaagcaagaattagcaccatgtggtcgctctttgcacctgaaggccaatcaacggagcagtttcgttctcaggacatgcgagcgcgtgtgctctcgacatcgtgttcatgacactaaagaacgccttttttccgcgctagtacaaactgtgcttcctcgatggtccattgcaccttcactttagttgatcgtttgccctgagagaaggtgccgtggatactgcgcgtcgaataggatgcgtttccgtgtttccttggctctctgtaatatgcacatccacggttcagggcaggacctgtcagatcatcacagtacatgcagtgagatgcatatgcatattgggcgcgtcattcagaatcggtaagtggtgtatgcattgaagtatcatgaattcagtagtcttattccgtaccagtctctcatcctccctcgtgcgttcatggctttgggcgttgatgccttcaatcctaattgttctttttttggcgtacacattcactgaaaatcagcaacgtatcttggagactggcccccgttcctccgccgaaaagattcccatcggggatcattcatgcctcagcgatggcctcggtcctgggcgatcggaagggacgagttcgcctcctgtagttctttgaagtcgtagaaaatgtcttttgcttttgcacagccgacaaaagaccacccaagtctctcgtacagcacctactgcgtcttagcgagaattccatactgatttcacaagtcgaaagcggatcttacgtagagaaggaagacacggccaagccaagccaagggacccgctgaaaaatatatcgagcaatcggagtcgtatgaagcgaccattgacaacgacgttgaactcgtaagaaacgccaatttgtggtgaagacctgccctgcgtctgcggcttgctggttatacgaggtggccgccaatagtctatgacttgacggcgagtccagatcagtagtacctaaggtgatgtcgcgcaggcagttgacttccagccgactagatgcggttgtctgagctgacggtgatatgttatcgacccattagcaaggatagccagtatgtcattggtgaacgaatcacgaacgtttgcaatggacaacacctgacggtcctcgccgtcgttcttccaaccgactgcagatgatgctgatgtcgctgtagaaaatggcgaagatggcgacagagtagtttctgctgtagacggcgacgatggcgaagaggaagtatggactctgacctgcgagtagcaagtggtggcaacaagcaatacgcagaagattctcttacatcgatttgcactatctgccgcagcctcggtcgggtcgctgcatacgcagcatttacacaactacgcagtcttgactgcatatagggttgcaggagaagcatgctgctccccgacaagactcctatgcaggatgcggacgatggtgccaagggtgcggcgacaagacggatggtatgatgtgcatgcatataggtgtgatggaataaggttttctttttgccaccatgtgggtgttggtccagtgcgcgccccctttttttatctgccgtgcctgcgtgtgtgcgtggtgtgtctccccatagcccgtccttgcagtcttctccacaccccccacgcatcagcctcaagtccctgctggccacagtcagagcggtcatctctcgtcgcacgctcagcatccatccgtctcgtcgcaccccacgcgcgcatcacccgcactcgcattcgcattcgcctcctgcagcatgaccagtctgccgcaagatgtcctgcagcggctgctgcacatcctcaccaacctggtctccaccgacaaccacatccgcgcagcagcagaagaccagctcaacaaggaatggatcctcaaccaacctgacgtcctcctctgcggactcgcgttcctgacccgcaacagcgacgatgccgacgtaagaacacgatggcaaccgaatgctgtccacgctgtgttgggcgcgagacttttttcgctatgaaaaaaaaaaaaaaaagaaaaaactgcagtggcaatctaacacggccggtcgttactcatattttagctaaggtcctttgtagcagtcttgacgcgccgcatggccttcaagaacgtcccctcaggcactgcggcgggcgacgtgacgttgtgggctatggtgcaggaagacacgaggatagcactgagaacccagttcctggctgcgttgatgaacgagaccaacaagtctgttcgaaataaggtctgcgacacggttgcagagctggcgcgcgccagcatttccgcagcagaaagtaggtcttttgctcgcgaacgtgaatgatacacactgagaaaaaaagggggggaggggggatctcaaaaactagaaactgacaagatggtgcgcattgtttgtttagtgtcctggccagagatcttgcctgctctgctggagtgcatctcatcaaaacccgagctccgggaatccgcgttccggatcttgactgcggtcccaagcgtggtctccagtcaacctgtagacacaatgaagacagtttttgaaaaaagtttgcaggacgagaacctccaggtacagttgtttctccctgaggctcacgcgactgtatggtggcaaatagccacgggatacagaaggaacacatcgcttcaatatcctttgcgttgctctacacttggcccgtccaaaattccccttgctgtggcgaaaggcactcacaccttgtggaacgttgtcacctaaccagcctgaacctgctcccacctaggttcggctggccgcaaccaaggcattagtggcatttttactcgatgccgaccactcgacccggaacacactagcgccattaatgccccctatgctggactgtctcaacgccctgctttctgcaagaaacgagccaggccttgtggatggactcgtggctatgatcgagctggcagaacattcaccgcgccttttccggcatgtcaccataagcctcgtgccgtttatgcttggaatcgtcaagaacaaggagctggaggaccctacacgacagtcagccctggaatttttgctgaccttggcagaatgtgcgcctagtttggtccgcaaaataccggatttcgcgcgagcagtcgtcccggtagccatggagatgatgacagagatggaagatgatgatgagtggtacagtgcagacgacctggacgaggaccatcaggacgacaactatgttattggggagcaagccatggatcgcctcgctcgagccttgggaggcaaggcaatgctgccggtcagtttcatctatatcccgcagatgttgaagagcgatgactgggcggctcggcatgcggctttaatggctatctcggccatcggggagggctgcgctcagattatggaagtggaactggccaagatcattcagatgactgtgccctttctgcgcgatcagcatcctcgcgtgcgcttcgccgcttgcaatgccattggtcagatggccacggattttggaggtcagatgcaaaaggactaccatgccgtggtattgaccaacctcattccggtcatggacgatggaccgttcccgagagtgcgtgctcatgcagccgctgcgttagtcaacttttgcgaatcggctgaaaagcggacactggagccctatctggatgcgatttttgaacgacttttatcacttctcagcacaggaacgacgtatgtacaggagcaggctatcacaaccatagccacagtcgcagacagcactgaagagcgattcgtaaagtattatagcgggatcatgcctcttttgatgaacgtgcttcagcaagcgacgactcgagaataccggttactgaggggcaaggcgatggagtgcgccagcttgattgcgcttgcagtcggcaaggaggtttttgcaccgcacgctcaggagttcatcaaattgctcattcaaacacagacaagtgttaccgagccggacgacccgcaagcctcatatctgttggcggcatgggcacgcatttgcagggttcttggacaggattttgtgccgtacctggatatcgtcatgccaccactactggtgagcgcacagctcaaacccgacttcgcggtcgtagacccggaggacgacgtcgagtccaaatactcggctgatgatggctgggaatttgtgggcgtcgatggacagcaattcggaatcaggaccactgtcttggaggagaagtgcacggcagtcgagatgctgaactgttatgcacgggagctcggacccggatttagaccgtacttggaaaaagttcgggacgtggctctgccgttgctcaagttctactttcatgatggtgtccgccacgctgcggcttcgacgttgccgcagctaatctcatgtgcccagcaagcagagctcggccaggagtacatgatcgctttctggcataccatattcctcaagatggtggaggttatggccaccgagtctgatcctgccttcttgctgcaactctatgtctcgttctacgagtcgctggattttatggggccaggaccaagtctgacaccggaattcctggagctgttcacaagggcgacagagtcacaactcaaagagttttatacacgtctgaagcgccgtgaggaggagcgcgccaacgcagacgaggacgatgaagaagcgattgacgatgaggaggtcactgaggataccgtgttgggcgagatatcacgagccattcacagtgtcctcaagactcatggagtagcctaccttggccacatcaagtccctcgagagcgtgcttgcaaccttcttgtcagacacaagcccttcagcaaggcagtgggccatttgcgtgctcgacgatctggtcgaattcacaggcccacattcttggccggtgatggtgccctacctcccatatattctggagtctctcttggatcccacggcggcggatgttcgccaggcagcagcatttgggttaggaaagatggggatgtacggtgggcccctgtacgcagaggtttgtagcgcagccttgacacctttattccaggtgatccacgagcccggatcgaggacaatcgagaacgtgtttgcgaccgaaaatgccatctcggcggtgacaaagatctgcaggttcaactgttcgcagtttgatgtcaatacggtcctgccatcatgggtccagacgttaccgatcgtccatgatgaggaagaagcgccctttgtatacgcctacttgatggacctcatagaagggtaagtactcgattgccactggccctggcgcctgtttggctttaataactcgacgatctcacatcgctctattctaaatcaacttgttagacaacatccgtctgtcctgggtctgaataatgtcaacgtgccccacctggtcactgtgatggtggaggctttagtggcagggatggttcctgaaccgacaacggcaaggatggttcgcgccctcaggtctgcgcttgataacatggcaccgactctaaaaaccaccatctggaccagcatttcttcagaaaaacaaaaggcgttgcaggacctcaattacctgtagacagtggtgtttgagcaagtagcacaaactgctcaaaataataaacggtttgacctcaccgtctcgcggatgaagccaagagctcatgaaaggaaacaacgctttttcttcaccatggtcaagctggtcctggtattattattgcatttggattacataagttgagctgagctctttcaaaaagatgaagaatcatagcgaacggtgcaggcagataatgagagttttgaacatgcagagtgacagtaacagtgagcaaagtaagaaaaaaggaataatgaacatgactctaacaaacacaatggagggtatatgataaggctgaggggtcaccgggactaacgaggatgcgctgatttttgtcgtcaaacatccacgccttgttccttttctctgtccacgatgctgacaatctccagcccggcgggttcagacttggatcctgattgtcgctgtcttttttcgagctccttctctgcctgttctgccttgtaaaactccacagcctccaggcgccccttctcaactacatagttgaatgaaggaaaaaatgggacagaggagaaaaggagacatattagacagacaacgagatgcaaaccgacttgaagtgctcttgatttcagaaacttaccatccacaaagaccatcatgacggcgggaataaagaactgggcgaccaagaaccaccaggtatgtcggatccctgctccttctataatagctgcacaaatcaacggccttgtgtttttcgtccaagttttgatccatgtcagccttacaattgtttcaaagaacaacggttcaacactatggtatatcttgatgagcaacttacccgatccacgatgccgatacgttcgcctagagtgacaggaggtatgcaaatgtcagcatccatgaataacacagatcaatttctgattatgttgacccatgaatccatggacgaggaaagaaaggggggaaggggagcgaaattcgatcgttcatgagccattaccatttcaaaaagtgcataaagttcattctcgtggccaagggggataaactgagagaagacgactctgttggaagaatagatcgcccccacaaacagaccaaaaagactggccaacatgtacatctcccaggtctgcttcagtccgacaggattcgacttgatcaaacccaagaggcagtaaaccggaatcagtccaaagagacacgagttggcaatgatcacctggagaggtcgaacgcctctgtggttctgaagccatatccagaaccacatgctcacgcccgcactgacatactgaagcacagcggccccgatcaatgcatcgttggtcgccttgagctgggattgcgccaacaagatggcaatattcgaggccgatgtcaagccatcaccgagaatgaaccaggcgctcagataatagaacatcgtcttgagtctccggacctgccggatagttttgtagatacggacatagccaaaggtcaatcggttggcgccttccggcagtgccggggatgtgcgctggaacgagagaaggccgtaggccaccagaaatatcagcacaaaggcagcggacatgatcaggcagtatccgatcatgagggaggaggcattcgtcgacatgagcacgatggcagccatcaccgtgagcacgaccccgcctgcgaatccagccgcagacgctcctccagagaggaaggtagccatcctcaccctcgcctcattgcactcgatcgagtcctctccgaatttgaccatagctctgaccacggtagggtggtgcctggccaggattggaatgtgtgcatcgtaaaagttcagagtaacaccgctaaagatgagtgctaggagttagaaagactagtgaagatcagttcaaggttcttcgtcccggacgagtggttatcctcgtgcatgttcgattgccgttttttttctcatttttaccaatgaccatcagaagtcccgagacccaccacagctccggtatcagtggccccacaaacatgaatgaggttgcgatcgccagcatcgagcaaaagaacatcagcagtttcttggagacccttccatggtctgcaaaggctgaagttccgagcgagacggcggtcgtgcaccaaacggcgaccacattgacgagaagcgcgtacgatgttggctcgaccttcatgaatccgagaggaaccacacacttgtcccccaaaggaatgtctgcgtccgacgttggacagggtattgaaggattcaattttaaatgcgaggcgctccgtgcgacctgttggaccatcaacggttgaaagatggcggttgcagtgttgctcatggcaaggtaaccgaatccgagaaggaaaaacgcccagagctcggatttcctgaccagccgttctcgcatgtagggctgaagttccatctcctgagagatatcatcctcaaatagatgcgcacgaagttgttggaggcggcttctctctgaagcaacctttattaagctgtcgctgctgccagcagcagcaggtgcggcgttggcttgggcatccatgattgcttagtcaacccactaaagacaggtagggtgactcgactcgaggagaatttttgatcaacagcaacaaaaaaaaaaaggaattcaattgcgaatgagacgagcatgcagcaaagagaggaatgaggcagtggggccaaagagagagagagatagatagatggagagagtgagaagagcacacacgagatcaaagctgctggtgaaaggaggaattcaagcgcagggtctcttccaactcttatatgcccaggattgggccaaagtggcatttgcacttgtgtagcaacagactagcagcagttcattccaatacctcgttgcgtgaataacgcggtttgtagtccgtccgtcgcagctaatcgcgacgttgctttgctgccatgttcaaaatcaaccaatccagtccctggcccagtccatcgccagtggtcccacaggaaccctggatatgccacggacgttcgccagtggcagtcttcaactgcagcaaatccctgacctctgccaccgtcaaggcgtgctggacatcgcccttgttggcgtaaacgagcagtggcaagtccttgagctcctctcgttcttctaggagatatcgaagttcctcccgggccaaggaatggctgattaaatcatgggctgccgagtctactacaaagatgagcccgtctgtgttctgcaggtagtagcgccagagagctagctcctgcgcgggttgtccgccaaccccgctcgaaatgtcccatataatgatgtcggtctttccatagcgtacctcctccacgttgaaatgcgccgtcgggatggcgctgatacaagaggcgagtttgagttgatatagaattgtagtcttgcctgcgtcggatgggcccatcatgatcactcgcggtccggagaatgaggcctgtgaagacgctttgctcttgagggcagacgcggctgctcccattgtcaaggttaacagtgctatggtctgagagatgcagggaggaaggatcaaggaaagtaaaatctgctcatgctttatattccgcgtggtctgggctctgtgaggtcacctcattgatttacgagggacgaccctcaggaggcagtgctgaatgaggtgatgatggcgcagctgctgtcgcataaatatcgccgcttgtaatacgtggtggtcggtggagtcgacaacgagaatcaacgattttttccaggttatcgcacctgggtgctactcttttttctgcatgggcatcgcaagataggcgcatagttatgcgaggcttcacttgctctatagcaagaatgtggtgccaaaaagacggtagaaatggacgtttgaaaagtaaagttctcgctgccgtgaggccacccaagcaagccacgccaggatgagaataagaagaagaatcataaaaggctcttcaacacccctcccctcgttcattttttctcccctttcgacacataccacgatttcatcaaacgcacacattatgggtctctccacatcaagactcttctacttcctcacaggccagggccgggatacaaaagtactcctgatcggaatgggtcaaacaggacagagcatgcttctgcactacctcaagcacggcagcgttggccggaaccccgaaagctctgttgggttctatattgagtcctggaggtgtaaaaatcataatctagctatctgggacctgcgaggcaggctggcgtgcacacctgtgtggggccataacgctgataactgccaggccatcatcctcgtcattgatgcgacccatcctggcgaggtgccaaaagccagagaggatctcgggcgactgctccaggtcatggaaaccgctccaggtgcacggagagatgctcctttacttgtatatgcgaataagcaggatgaatataacgctcaaccgaccgacgacatcgtgaggtttctgcagttggagtcaagaactgagcgcccctggcatatccaagagtctatcgccatagcaggtgtgggagtaatggaaggatttgactggcttttgtcccgactggagccgaagccgactaccctttgaacggaatgtacataaaaagaactatcattcaaagaaattgtgaatagaggtttggatccactgtatgtactaactagaaacagatattgttttctatacattactgggccgcgacaataccaggcatggccaaagccgcatcgccctctgtcacaatcttgataaagacgtcctcaagcgtcgtctgactgacaccccagtcctccaccgcagggtagcgacccggctgcgacagctccgaaaagaccttggagagctgaccacgcgcctgagcctcggagccctgctgctgatgcaagtggaactcgtaggtggttgcattcgtgaacttgtcaatccttctgaaactcattccagccaaaacctggcgctctacactttggcaagcctcctccaggcggccgggcttggaagaaatatccagtcggaatcctgtcccatacagctccttcaagtgcagcgacgttccagtgcagcggaggcgacccaaggtcatgatggcaatgcggtccgacaagatatcggcctcctccatcgaatgcgtcgtcagaaccaccgtcttgttgaccttgacccggttgatgatgtcccagatgactcggcggacggcagggtcgagacctgtgctgggttcgtccaggaagatgaccgagttgtctccaagcagcgcaatcgcaatcgaaacacgacgcttctcacctccactcagcccgaggatttgacgatcccggaaacttgtcagcgacacggaagcgatcgcaaagtctacagcttgctgttccagactaggcgggataccgcgcaaacgtgagtagaacagtaggtgatccgcaacggtcaagtcttcccacaaaatatcgtgctgaggacagacgccaatcttggaatggactgtcgccatgtcggtacggatgttggcaccagccacataggccgttcctgaggttgggctatacaagcccgtcaagaggtggatcaaggtcgatttaccagcaccgttggggccaagcaggccgaggaccgtgttgttctcgacaccaaacgacatgcctctcagggcaggctcgaccttgccgcggtagcggtggaacaggccgtcgatgatgagaggggtctttgcaggatcgtactgggttctgacgcgatcgcgctctgcatacacatcagcatcaccgccttcgagaagatcgttgtcattgctgacgtggcgcgatgccagacgagattcagggtcacgcggggcggctttcttcttgaagagggtggagacaggaaagtgccagggcttctgaacaccgtactctgagggggcaacggcgtcgatatagctattggaagagtaatgagcaaatattagcaaagtgtgttggaaaagaatatgaatagtgagtcgatttagggctcttgagacgtgctggaaacgctggcgagcgactgtctacttacaaagtcaacagaatcatgaggacactctcgcccaacatgaacatcaggcacgtgaaaagggttgtaccaggtgcaaagtctgtccacaccaaaggataaaagccattgacgcgacttgcatgaagaattccggacgagaggatctgaaagaatgcgaagctggggtggatataccaagcggtcggcacgccattatccttgaagagctgatcggcaatactggacatgatgcacgagatggcgacgaaaaagtacacaatcaaagtggcacgacgggttttggaaaagcaagccgagatcaaaaaggccatagtggcctgagcgtgggcccagacaagtagaacgacgatgatgatgagagggttggtataaatgacgagctttgaagaaatggcggcgcaggcgaggcagaagaacagactgagaatcatctgcatggtgacaaactccacatagtgagccaagtaataagacaccggcttgagtccgttctttgcagcacgttaatgcaattgaaaaaaaaatgcagcttggttagagcagcaaagcttcaatcatgctcatctatagcaaactgccacaactgaaaatgttgctctttttgggtctttcttaccatggccatcatcatgcggtggcgatcctccttctccttgaccataagcgcgacaaaagtcggaagcaggaaggagaggccaaaggggaaaaggcgataagatatctcagtcaactgtgagcctttcaagatgctagagtcccatttgaagggtagtgccctcaatccttgtgaaatcctgaactgtgttggatacttgttcttcaccatagccccagtcatttgagtcatggtaatcaactgcctaagtcctgaaggtgtaacttcatccgcggaatacgggttgacggagggctgtccatattgcatcgtcatcttgatacttgattttgctgggtcgatggcatcaaacgacactgcaccccagggcatggtcttaatgtcgtagtccatggcagcgtacttttcgatcacttccacgacagcctggtcaagtgcagcctgatcgggtcgcgagttaaacgtctgcgccatgtactgcatcgcaaagataaggtccggacggccgccacgagaaggagctgtcgtgttgacggtggatacttccctgttggcatagcggacaggaatagctcccagcaggccagtgccaggcttgacaccaggagccgacgcgttatatacgacattgcccttgggaggccatgtttcggaaaagaaagtatgggtgacgttgggaacggtgccgagctgttgggcaacttgggggttggcggttaagtaaaagatggtttgattgatcaagggcatcgaccaaagcgctggctgttctcctccatacccggagttacgacgtgcgtttctgagcccctcgagtttaaaccaaccgccaggagggccaggcgtgtaatagctaaagaaacaagaacggcacttagtatactacgcaattcacaatcggcgcacgacatgcattgtgtgttgtaaggtcttacctcgagggctcggccgcatcggccgcgctgacattctcatatggagctttaatcggatgcgtctcaccaaaccagcggacacaaggcagttgggtagtataatccgaggtgaacgcttttgggtaccaggccgccttcagctctgaactgccggcctccagtgaaggagggccgctcagagaaaacttcgggctcgtattgggatcaacttcattgacgcagaaagctatccggctgcctgtccctgagttgccgccgccgatgagcgtgaaggcaagacaaagtactaccaggagaacaggccaaatgatcagacagcagacgctggtaaagcgttggcgccggtggtacgagagcgcacgccgagccagggctctgaactgatagcgggctgaaggcgtcacctgcgaaaagtcgacggcgggaggaagaggatcatgttgatggggctcgtgttttttgaggctgctgagctcgtggcccctgtggagttcgtccatgggaatgtgggtgtgctgattgtgataaggttggacgagggcgttggaggaggacgagtcggagaggcgaaactgatctacttcttggcgagcttctgttggctgagatctgaacattgcctgcgatgcgatgaacgtattagaggagggatgaccagagaagccaagtgggtatcaagtattacagaggaattaaagatatgggaagagtggttcaggcgacagtgactgccattgggatctgttctccaggtaccagcagaaaggaagtaagcagagtgagatgggcagcgagagattgttggtaacagaaaactttacgcagtatttatattacttgcggcgcatgagatttcttcgctctgtgtcaccgttgggcagaaacctaaaaagaaagcctacgaaatgcgcgctttacgtttagtgctggtttgtgcccctgacaactcgacaagtagacaagggtgagagatactccagcagaggcaaaacctcaagtcgacattagcgttcaaacatgaccgtgggctgttgaattgacgggcgtccgatgtcttctgtgtttcaataaactgtttcctcttttgattcggcgacagcagtctggtaaaaaaagattgaatatctgccattgagagcacgttgacacaaaaaaaaaaaaaacgactttgacgccttgacaaccttaattgacagacagcgattctcttggcaatgccaagaaaaagtattgcagtagagtatgtaatacaccacgcgcattggcaccgtgggtcaatcttgctgtggaaccccccgtattctcgcctgtcctccacgtcgcaccgatcctccagccctactgtacctcagcagcccagccttaaaaagagatgtgctgagtttatgccaagaaatcctcccagtgcacatgtgctcctactgcagtatttgtagtcgttttgccggtactgttcctgtatcctcgcccacgcgacaagccggcgttgcgttgcattaaattggtaatcctctacttgggcgttgggcttttaactgcacgctgactttcacaaatcgtgcccttggctgtttctttgcagcaatattaatatccttagggagccatggctgctgttttccggggttactgaggtcaattgcgacaacaaagggtcgcatgatgcaacacgtcctcgtcgtcaatctgaacacgttcacgtagcttgttggactgctaaatttattcagtgcacacttttaactctgtgcaaagcgggcaccagcgcacgctacacctcaccctctgcatctttttcactcgtaaccatccattcaaggtaacccagagtcctcgtctcccgctgcatctggtgcagctatccagtcgtcagcacccagtctaacccacaactctcctacatccactctgctccagatgatgaacgacaatcagctcaccgcattcgccaatggtatctgctgcctggccatggttctcatcgttggctaccactttgtcgcggtcaacggcaagcccgtctaaagaagtaaagagtccctcttctcactcccttcttccttcaaagacggaaagaaagggaaaaaaaaagaggaaaaccaacacaccatctcaaaagcagacaggcaggcacgattcaccaatggcaggcttccagtggagcattgtgcgacgtctttttcacttcaaataggaaaataaaaccgtgtactatcggatgttgtcacgaaggaaaataacagcgcgaatggctacaaagacggtgtgtaaaagctactctatgtaagttctaaagatcatcatagcttaggatccttcgtcctcgtccttgggttgcggctgctgcagcccctggacccatttcggccggcggaaaggcagctgcacccgtcggtttgggaggcagtttgggagatcgtgggcgaggtggcaattgatggacggatcgcacaacggtcggtacagtctgaggcggacctcgggtgccataggacgctcccccaatgctggtgatcgcgtctgccgtcttgccctccgaggccttcttcaggtccgcggaaacatgccgcgacggcaggatgttccctgccatggcggcagcttgccgatgctgctcctcctctagttttgccaactcaccgtcttcatctgtccacgcaacgcccgcaaaccctctgcgattcctctctggaatcatagccctgttcactttgatgaccgcaccctcaatcgtggctccattcatggcctcgagtgctcgtcgcgctgcctcgggctccttgaaggtcacgaatccgaagtccttgccctcaaccaggttcatgtcctcgatctccccaaaaggtccaaaagcagcccgaagtcctgttagtgagaccgactcgggcaaatgcccaacgtacactttggtgggataaaaggccgtgtcaagataccgactggcggccacatatggatccgcacaagctccagtgccactggttgcattcggtgagggtgatcgatgggtgcaatcgtcatcatactctgaccgacgttggcgagggtcccgttcgcgccttctagagtactgaaaatacgggctggcagagcgcgaacgggaccgccgcctatggctcccagagggcgagcgcgaccgagagcgagactgagatcgaaagcgaggatcataacgaccagaccgatgcggtggaccctggcggtcatcattatatctgtgtcttcgtgatgggtgtctttttgtttccaggtcgatatagggcatgcaagcagcaaaaccacagaaccacaaagatgagtcattcaatcataaaaacgaccacggctgcctccagaggatcagggcgcaaaaaaaagtgggtcagtccagtgaagacgagctggtgggagggggaacaaagaacttacgcgcgtccgctttcatgatccgaaccttcatccgaagattggtggcgggacagggggatggatctgccatagctgtccagaaccatttcttcactgccctccacgctgttggcgcgactgtgtgcaacattgtgtgtcatatcccggaccaattctacaatctgctgcgagtttgagtggcatctctttttcataccacggtccgctttgttggtgtgcacgtcttccgtcatgggcgatgggatcggtgttggaggcgtcactgtcgatggactgtcgagaacaacagggcaggacatcgagccgctggaggtgatggaacatatggagagctgtcgtccacgatccatgtcgccgataggctcctatacgcataatttcgttgcatatgagaacccagtcatagagaggattgcctatataagcgattgaatgtgagccagagcagatgaaagttcttacctccctggggctaagtgcagacggagtgccctctcgggcttgcctcttttgttccggtccctgagtcgagctgcgagccgccatggatgaccttttcagctttttcaccgttcctgtggtggtgcctgtgctctcgcccgtgctttcggcagctcgaacggccgcgccaaagcccgctccgctgctagcctgctcctcaacacgctcactgcgtccgagcggacttgtgactgacgaggaagaggacgactgcgaaagtctgcggtgcgcgttcgtacctccgcgcccattgttggacgagctggccctctccatgcgtggtcgtctggtgtcatttcgagatgatgggtggatgcccgccgttccccttgttactgctgttcctgggaagttgacgcctgcaattgcgaaaatgtcgatggggttgtcctttgccttggcttccttcaactccttttcctgttgtgacgaatacagtttagggaggtcagtcaagtttatacagtatgagttgtatgatgaccaagtccttcgtgagacgatgcaggggccacagtggccttactgcagcaagaacgcttactcgcttcatttgctgcaccagcgcaaacttttctttcagcttgctctccatggtcaagtgcgaatcccggcagcagtaagcagtagaggcagtagtgtgtaagagagaaccagggatagctaggctgagccgacccaactgatttttcgaactgcgctttgtacggtgcgcgtcgaactgacaatcgtgaggcggcgtgctgtgggtggcaggggcagacggaagcacaagggcacagcgaaggtgaacagaggagaggacagaggaggacaaaggagggcgagatgagagggatgcagagtgcaaggatggggctgccgatgcaaataggagtgaggggcatgagccacgagcggcacgagcacccaagtcgtgagtgcattgtccagtctacctgatcgcaaacgctgcgcgtgactgtttaggtttgcaagcctacctggtcgcaaacgctgcgagtgactgtttaagtttccaaatccttcaggctttgccgggtgggaagtggctacggcagtggtggtctacaaaaagggttttcatggcaatgcagtcagaggcgccgtgcgaccaatttgtttgatacaacaggcaggaggagggcaataacatcttgtcttatgtagccccacttctttgctaaaaaggcttggacgccataatacagggttggtcgcatgtgcttcctattatttcatgcaggtttctctgtgtaacttcctccacgagataaccgcacataataccccatggcccacacctgttacataagggggctgtttatttgggggtagattgggcgacccttctatctgtatctagagggccgccctggtatatattttttctctttccccttgtcgcggttagagggaaagacacagactaggagctgtcaagtaacgagaacggagtgaagcaagatgtattcaatgtctcctgtggacgttgtggacgtgggcattaaaggacacgtccacactaatcttcgccaactaaaaatactaagggtaagtctatgctaggacggtcaatccggcacactcttcctatcatactgaagcaaattcagtaagcgttggattgttcacccactaatagggaacgtgagctgggtttagaccgtcgtgagacagggtagttttaccctactgataaaatgtttgcaatagtaattgaacttagtacgagaggaaccgttcattcggataattggtattaggccctgcttgagcaagcaatggcccgaagctatcatccgttggattatggctgaacgcctctaagtcagaatccgtgctagaacgcgacgattaccgccttttccgatttttagttgaatacgaatagacctccgggtcctgaatcatacagtattacgtgggtcttgtggagcggaaaggctttgtttggcgcctgctaatgttattttcaaatcttggaagagataaatccattgcagacgacttttgagcaacggtgtattgtaagcagtagagacgctctgttgcgtcggtttgctgagattaagcactatgttgtaaagattttgtttcaactgggactcatcccccttctttttctttgttttaagagtttctacatatgccttgttggtcggattgcggatagccgggttgagttccagtggctgagcccctatgcgcttatttctgttcaatggctattcgctgatcctctttcaaactttgtgcaagggcagcactatcaccatagcaccctgctctcaccgtaatagtgaaagccatttttttttccctctttctctttatgggtaatccatcagttgtatgtggataaaggtgtgaactacttcgcttatagcatctcgctctaatcgacttaaaattgggcctttaacgaatgttttatatataggattgcatgggatttggttttgtgctgaaggcagagaagttggaaactggcgtttgacccaaaattgtcaagttattttgtatgtctaatcgttcagcatgcgctaaaagtccaactgataggggcgcgacccatgtcaagggaataacctacagactggaatgccgttggcgacaagttcagtccagtgtcagcgcatccgatgcgtgttccaacaatcttaaccttaatcgattggcctgaatttcctgttacagtaatacaggcgccgcatttcgcgttagctcccatcacaccaggcgatacctcagtgaccgattcattgtcattatttgaaaaaccacacgagccgagaccgaagtttgaccagctagccacgccttggaaggcggcgacatggtgcaccgagagaaccgctgggagtgcaagccaaactatagcgaagtagaggtgcatttttgaacaaagtaaatgcaagacggtgctagaggcaacgtgtaatacaggttagtcaaatcatcaaatcgtcatggggcaccagtctccattcataattactttcttaccaagagaacaggtgttggtaaaacttgagtgtttgtccgctcgagcttttaaaagggagggttcatggaactcgggtttgatgaatgtcagcgcagacgcagggtaggtgcggatctttatatacgtgaagagcgttgaaacaagtctaaatggtctttttctctctatgcccaaatgagaacaaagaagtacgcaaaaagagcaaaggagatacagagagaaaaaaatgaggagggatgcaaaaagagatcaaggagatgcagaagtagaaaaaaagaggaacgcaaaaaaagatcaaaaaaaggtgaaaggggatgctgctaaaaggaggcacataagaatacgtggtggcatcaaaatcatagaataaagggactaacaaatccatgagaaaaaaaaagatgttattaatacctgtgtctagagggccgcccaggtatatattttttcactttccccctcggagagacctgttcatatgaacagttccaggacaaggtgtttaatgttgctccgaacacgcctatccgtcggtttttattcagaatcctagactcttactcgagatatccaagatttttcaatattccaatcgaatcttggtctaatgatttgaatagaagcactaggtgcgcatgcaatagccagtgggccaagtaggttccttgagacagctacatccagagcagcaagggtcaatgcctgccaaattgaccgtgcagggagcatctgggggttgacatgcttgaacaacacttaaacttctgctgaagactgcgaccagaaacagcacgagatatgtggtcttgggatttatcattttgtcggttcctgtacagtggaaaaatgcaaatttctttcaagggaggtgtgggatgccagttacttgctggggattctcgcagtccttcttattacctgtttgtcgggaggtttttttttggcaggtcctgtgggagaggccttcgcgataagatcaagacgagatgtgcatgtgtgagtgtgaatgaaggatgactaggatgggaacatcctttttatatatctgtgagatgaattgaacgaactaaacgcttatctatctgttatggagagaaatgagggaaagaaagggatgaaggaaagaaagggatgagggagagactgggataagggaaggaaagggataacggaatgaaagggatcactggccaagcattatagagcacaatactttttactgtcttgattaacttaagatggagtagtgtctgtctcccattatgttttccttggatactgtgagcgttatggggttcatatcattgtgttgcagggaaatgcattctttcttctctcatcgtatctcctatcatatgctgcgcccgacatggagcttggtggtgctttctaaagaaggtaacaaactgttatggggtaactgtatagccgacatcatggtgccagaacaatggcctcgcccctggccaaaagtcatatttccgttgcgactgcagcaattagacagcagtgcagtgtacagtggtttataccattcctcgatccggaagactcagagccacacgctctgcctctctgtgtaaactgtgaaaaaaggctctctgtctctctggtggcaatcagcacagcctcataacaagtctaaaagttccagacctgtcttagcgttgttcgggctgtgatcttgaacatgccagccgtcggagggtcgactcttgccgcagttgtgagccgtttgtgtgagccgtcgcggcgtttttattcgatctctttgttcaggaggcacgccgcgcctattttttgctttctgtgttgacaccccgggtggaggttgctcatcctttaaaaagcaagacctcgtttccctcgatagcgacatccgacatcatcgcctcttcttcatttcctctctcctccccacaaacacacgcacccacccaacgatacaaaaaatgagactttcaaccctcttctcgttcgctgtcctcattgccgttgccgtggctgccggcaccacccctgtcgaggacactgaagccttggccgattctgctgtttacaaccagatcgagccccactttggctccaccttgagcccccgcgatgaccccgccaacattgagtttgtcagccttttggagaagcgtcagagtacgaatcccgaggatccctgtcgacctctgttcatgtatataaaaagtcaacgcatgtgctaacagtctgctctatattcgtttaatcctttcactaggctgccccaagggaacgggtctctgctctaacgacagaaagcgctgctgtcctcttggaggacgatgctgctccaagggcggctgctgcgataagggccgcttctgtgtcggaaagggatgctgccccaacacccagaacggttgtgacaacaagggatgctgccccaagaactggaactgctgcaagggcggtgcatgctgcaagcccggcacctattgcgtgaagcgcaataacggatccatcggctgctgcccaaatggcaagctctgccgcgcataaatgccaacactccaactctctctctctctttctctctctgtggcattgtcacgctagtgatgtataataaaaaaaacccccctccggcaggtttacatgccgatgtgtacaaactctttccgtggcaatgatttctgcactttgtattattttgtaagactgcatgcagccttgtgtaccctcactttttttcgaatatgatgtttacatgctgcacgaccatgtggatagacactagctgcatcgcgatattggctacacggaagatcattcagacttttcacaactttatggacagtaaaagagaacgcgcgattctcactctcgcaggggatttaacagtcgatcacgatcgatttccactcggggtaatgttcataggattcgttctcgtcctcggaaaactctttcacgacacgcccagcgcagtgatccttcttgtaggcacgacctcctgagccatacgggaaccatctgtagctgtcatggtacggaaggttgtggcaaccgcaggacttgaccgcaacttgctcacccataaagtgatcaaacgagtacaagacgtacgaccccggctctgccgagactgccgcggcgacggaatacaggatgatgcagacagagaggaagcgcatgatggtcttggctagagtgtagatgggatgctgctttcggtgattgaacagggctttcttgtagtggacgtgctgtagactgactgtggacttgcttaggacttgcttttggtttggatgggtttgttgcaagaaaaaagaaggctgggaggcgatgcttcatttataggaaatcatgcctggcgggagttacttacgagacgtccagaaaagagggcaagcgcttagatttttgttggtcatcatcctttgatggtgcagtgacatgcagcgcggtaaaataatggaagagggatgatgcatgaacgcgggttgattttttgaaccatgtaacctttccccacttttacacttttacactttgaaccatttgaagtttgaacgcgcttccatatgtggccgtggggctcacacccatcgcatggttgtgcgcgtctgctgcagctggaccatgtcgttaggaccaacgcttcgctagcagagggcaatatgcacgcatgccatgcgcaaaaggcgaccgcagtttagaccgcgtgtgtagaccgcgtgtgtgagtaggtgtgttgatcacggcgagaatatgcgcgccatatttttttcgtctttccttccctaggcgcataaagcatacatacagtacatgggtatttctttctccaggaactaacaatctaggcttcaggcaccggtgcctttcgagcatgactctggccttgactacaggataagcgtactgtagtgcggaggatcaaaaaaataagaaaagaggtatgtaacgcaagccaccgacaacaaaaaaaaaaaaaaaaaacaacagcaggtcgcagtacagccgtgcaaaaaaaaaaaaaaaaacgaaggaatgaaagacaaacacacacccacgcatgaccttttcttgttttcttcttttcccctcccgcctctctgctcccctgctgtccggtgtttctttttctttgtccttgctgtctgggtcgtcgtccttgtgcacagagaaagaagacaaacacatcccacatcccacatcacttcagcactcccctctctctctctcgcccttcttcctcttcctcactctctcgctcacgctcgctcgtcccattcgtctctgcggcctgatcctccttgtcgccttgtcgaatccactggactgaggatccgcccctgctgtccgaaatcacacccgcctgatcacctgcaacagccatgaacatcgcacgccccaacggaacagaggtcacctccgtggccttctcgttctacgacgcagaggaggtcaagcagatctcggtgaagcaaatcgtcaatcccgtgctctttgacaacctcaaccatcccacaaaaggcggtctgtacgaccctgccctcggccccttctcaaagcaccatgtgtaagtcgctggcccctttgctcgcctgtgctcctgtgcgctgccaccgaccgtgcatattcgccgtgatccagcagagggccgatccgagacttgcgaacgcgccttcgatcgagacagacgagcctgatactgatcgcttcgttttttgtgttgacactacaggtgcgcgacctgctcgctggaccactttgcctgtccaggccattttggacacatcgagctaccctgcccggtcttcaaccccatgttcttccctcagatgtaccagatgctccgctcctcctgtctcttctgccaccacttcaggatgtccaagagcgaggtacgatattcttgtgaacacattcacttttggcggcctctaaaatgctctggatgacgatgcagcggcctaacctggcacttggttcattttctcccctcccacatagacacaccgttttatcgccaagttgcagttgttgaacaaaggacgcttcttggaatcaaaggagatcgacaacatccccgttgtgagcaagaagggcaagcgctcgagcgacgacatggatgtggacggcgaggaacagcccatgggcgaggacgagtatatcgccagactggagtcgtatgtgcaaaagtgtctgaagaagcacattcacggtcatgaggattacaagaccacggtcgtgaacgatgagcgcaagcgcatcattgccgacttttaccgccgtgctacctccaagaagaagtgtgagaactgcgcaaggtagctaatctgcattttggggcgatctcgtattgtgtctgcgacttggtatgaagaaaggcaccgaaaactaaaccgtatatacttccttttatttttttttgctatcaacagtttctcgcctactttccgcaaggacggattcgcaaagatcttcgaaaagccactgaccaagaagcagcaaatttacaacactgcccagggacgcatccaaactaatgttctggccacccctgtcaagaaggctgtcgccagtgactctgattccacttcagagcacaccgaggatgaggaggcggacgcagacgatgatgcacacatgtcctctgagactgatgaggagacaaagaagaagcagaaaaagaccaaggccacaaagaccaaaaagtctagaaacattgtcgacagcgacgacgaggatgccatggagctcaaggacaacaacaaattcctcaccactcttcatatccgcaacattctccgccgcctctttgctgcagagcagaccatgtgtgccctcctctacggtgctaacggaccccatatggaaaagaagtacagcaagaccgtccaggctgacatcttcttcctcgagatccttcccgttgcccccactcgattccgtcctgcctcggtgatgggcgacaagttgtttgagaaccctcagaacgagcacttgggcaagatcctcaacacctgtgagcgcatccgcgacttaacttccaccaacaaggccgacgaggctctcctcaaggataagcgtgcttcagccttcaaatatctcatcgatgcctggatccagcttcagcacgacgtcaactcgctcattgactcgaccaagaaccccacgatcatgcgcggtggcaagctcccgtctgctggtatccgccagggtctcgagaagaaggagggtctgttcagaaagcacatgatgggcaagcgtgtcaactatgcggcccgttccgttatttcgcccgatgtcaacatcgaaaccaacgagatcggtattcctcccgtcttcgccaccaagctcacctatcccgagcccgtcacccactacaacgtcaaggagatgcgacgcgctgtcatcaacggacccttcaagtggcccggtgcagcctacgtccagcacgaggacggcaatttgtcctcgctctccaacctgtcgatggagtctaggatcgcccttgccaaccagctcttgaccccccaggactctcacagcggcgtctcgaccacctctccctaccccacgcgcacgcagcccacgaacaagaaggtttaccgccatctccgtaacggcgatctcttgttgctgaaccgtcagcccacccttcacaagccctcgatcatggcccataaagcccgtatcttgccaggagagcgcactattcgcatgcactacgcgaactgtaacacctacaatgccgatttcgatggtgatgagatgaacgtccatttccctcagaacgagattgcaagagccgaggccaagctgatcgccaacactgactctcagtacttggttcctacctcgggtgcccctctgcgtggtttgattcaggatcacgtcgtggctggtgtgtggatgaccatccgtgggtcgttctttacccgcgaagagtaccagcatttgctctatggtgccctccgcccagaggtcgataacactggcaacggcaagatcttgacgctccccccatcaatctggaagcctgtccctctctggaccggaaaggatgtcatcactgctgtccttcacaacttgaccatcggtcgccccccactcaacatgaccgccggtgctcaggtcaaggcccagtactttggaaagggtggtgaggaagagtcgattgtgcaaatcatggacggagtccttgtcacaggtgtgctcgataaggctcagttcggtgccaaggcctacggtttggttcacagttgttacgagatttacggaggcgacattgctggcaagctgctcagtatctttggtcgcctgttcactcgctggactcagcgctgggcattcacctgtcgtatggacgatctgcgcctcactcccgagggtgacaagtggcgtcgtgatctccagaacggtggcaaggagattggtaccaaggccaccctcaagtatgccaagatggactgcactgtcgagcagctgaagaagagctccaagctgcagaaggagtttgaggagaagctcgagaccgtcctgcggtcggacgagcagctggctggattggacgccaccatgaagtcgaccgtcaacgagttgacgacctcagttcagaacgcctgtatccccaacggactgatgaagaagttcccccacaacaacatgcaggccatgaccgtgtctggtgccaagggatcttacgtcaacgtcacgcagatttcctgcgctcttggtcagcaagagttggagggtcgccgtgtccccatcatggtttctggaaagtctctgccctcgttcgcgccctatgactcgtctgctcgtgcaggaggatacattgctggtcgtttcttgactggcatccgtccccaggaatactacttccattgcatggctggacgagagggtctgattgataccgctgtcaagacttcgcgttctggatacctgcagagatgtttgatcaagcatttggagggtcttaaggtcggctatgaccagactgtccgcgactctgacggctcgatcttgcagttccactatggtgaggattcgcttgatgtcatcaagcaggcccacatcaaccagttcaagttcagtgccgagaactctttggcgctcattgccaagtacaggcccgctcaggtgctgccattgttgaaccagacagaagcaatggctcataacaagaaggtggcccgcaagcccctcaagtatgaccctaccctcagcctttactcgcccagctcgcatgtcggagctgtctctgaggcgttcgagcagaggctgaacgactatgtggagaagaaccccgatggcatcattcagagcgccgatggacccaatgacaagaggtccgagcggttcaagggtctggacaagaaaaagttcaaagccatgatgtacctccgttacatgaactcacttgttgagcccggtgaggctgtcggtttgctggctgcccagggtgttggagagccttcgacccagatgacgctgaacacgttccatttcgccggattcggagccaagaacgtcacgctcggtattccccgtcttcgtgagattgtcatgaccgcctcgaccaagctcaagacgcccaccatgacgctcaacatcaaccctggagtgaccgagagccagctgcagtcgttctgccaggacacttcaaggctcacactcgcccaactgatcgacaatgtgcaggtgactgagaggatgatttccaagaacgcggcctcaaaccagaagcgtcacaaagtctttgctatccgcttgaacctgttccgtgaggaggagtaccaggccgaatacggagtttcgtcggacgacgtcgaaaaggtgattgaggcccagtttgtcaagaagctggagacggcgatcttgcgtgatctccgcagggtgtaccgcaagaccaagggtgtgagtgcggacgacattggaaagcccagcaaggccacggacatggaagcgggtggcgatgacgcgcatgcagacgagggtgaggtttcgcgccatgatgctggaggcgatgagagcgacgatggcgatggcgatgcgacctcggaaaagatctcgaagaggggcaagcagcaagcctcgtacgaggagcccgactcggatgacgagaaggtgatcaagtctgcagacaaggcgcagagggagctcgatggcgaggactctgatgtcgactctgaggagagcgaggacagcgaggacgaggttgaggacgaggctgacaagcgcaagcgtttggcgcgggaagccatgaaggccgagaagcgcggcaagatggcagaggacagtcgtcgggaccgcgccgagcgcattcttgccaagagcccttatgtgaagaagtactcgttcgatagcgagcagggctcgtggtgcgagattgagatgcacttccctgcagacaccaagaagctgctgatggtgaacctggtctctgctgtggcgcccacatgcattctgcacgagatcaagggcattgagcgcgtgttcatgtcggagagcgagaagggcaagcccgagattgcgacggagggagtgaacctgaagggcatctgggagtactcggacttgatcgatgtcaactcgatctattcgaacgacattggtgctatcttgaggacgtatggtgtcgaagcagcacgtatggcgatcattcaggaaatcagcggtgtgttcggcgcctacggtatcgatgtggaccgtcgccacttgacgttgattgccgactacatgacgttcgagagcggattcaagccatttaaccgcatgggtatcgagtcgtccacgtcgccgttcttgaagatgtcgttcgagcgtacgtgccacttcttgacgcaggcgacgctccatggagattacgatggactggagtcgccctcggcgcgcctggtgatgggcaaggttgtggagggaggcacgggagcattcgatgtgatgcagcccctggtgcccgaggccatgagtgtctgaagcggagccgtttccgacggcgaataacatctttttgcgcatagctttcattgttttttgaatatatataaaaaaaattgcatcctctaagcactcctgtcgagactgcacgagaggaagggcactcttccctgatgggccagaggaacaaggttgggttagcacgcgccccgtgctcaaggtctgttcgttgacagcaagaattgcactgtcaggttgtgcgacaggcgaatgactttttttctttttctggttccacgagggaaaatttttccttcagccaggcacaaagaatgtgtgtggtggtataaaagcaggcctgctgtggcacattttccattcttccacccacacgcactctctctcacactttctttcccttccctttttttattttccctcgatcacaaccatggccaacgctgctaccgtcaaggacctgaacgccgccctctcgttcctcaccatgggggacggagccctgcccgccaacctggccaagcccaaggtcgccattgtctgcggctcgggtctcggcggtctcgtcaacatcatccgcaacaaggtcgagttcgcctactctgatatccctggctttgtcaactcgacaggtaaacagcgtgtgcttcgccctgtggcccccatctctctcttttctatacaatcaggaagcacactagatggacttggacagcactcaggaggatcgagccgaccccctcagctcgagagtagcatcagccattgatcccacctagtctttcgtttgttcgagtccaacctggaacgaagttcaatccaattgcgtgccttttctggaaccagccatggaaagcgtcttacagaacctggaaagagaaacgggcgattgtcagggatacccttcaccgaaaaaaagaatgtgcttagcaccgcgaggacagaaagaaacggatcatcattccacctttttctttttttcgaaaggcagtgtcgcacactggagactcaccctacgcccgtcctttcgtattgtgcgacggttgttttctttctgttttccactagttgctggtcatgctggcaagctcgttttcggtctcctcggtgacaatgatgttcctaccgtctgcatggtcggtcgcttccactactacgagggattcgcactcacccagaccacataccctatccgtctcatgtccctcctcggtgtcgagacccttatcggtaagttgaaccaacacatggtttcctatctctctctttctgtctctgtatgtggagtatgtgtgtgtgcctgtgtgctggcgagactgttgggtcgctcagggtcttgctaccccgcatacacaacaaaacaaacactacacaaggtcttatcaactcccatttgtggataagcgaccacaaagtggggagggagggtgtgccgtgggtaggcaggagcaaaacctttctcctctgtcgtccccccacactgccaatcggaaagacccacttttttttttttttttttgtgctgggtgtatttttatttttttacgtctctttgagccaaaatcgcagtcggatcgacccctcttgttcctaaggcgttcattggttggctgggcagccgtcgaccttccgtccctgtttgatcctcccttcaactcttggtgcccctttttgcggacggttgcagccatggcgggaagcacccaacttggaaggggcagtttcactggaaggatcgttggttcgctcgactgtattggagactgagtccgacatgcgacgtggtgacatctgcactggacctaaatggaagccgtggaaaaaaaaaagatttcaaaaaactggagaatcagagcatggagagaaaccataatgcaccccgcattttttgtacctcgtgtgatgctacagtaccgccttggacactattccaccgcccccccaccccagtttcttcgctctttgagtgacaaaggggaagagggagagtaccaggagaatggtacccatcggcgtatcaaccacgtataccccacacccactcttttttttcccctttctgcttgagcattggaggccccaagatgatgatccattggaagggacaaaattcacccttcagaaatgggcgcatttctgttttgttctcattgcgatgactttctatcttatctgacctggagtattctggagatgtccggatatggctgatcgcctggcgttaggacgtgcacgaggggggagaggaggatgatccaggaccaacaatcttatgaagactcattttcatttcttcgtgtggggttatcgccaacactggagaatggcacacttacacgcatttacgcacacagacgcacaacccacttctcgttcttggcaactcacctcggtcttcatgtctcgctcatttctatcctagtcaccaacgccgctggtggtctgaaccccgccttccagatcggagatgtctgcatcatcgaggaccacatcaacctgcccggcatgaccggcaacaaccccctgatcggccccaacatggccgagttcggaccccgtttccctcccatgtccgatgcctactgcccccgtctccgccgtctcgtatacgaggccgccaagaagttgaatgtgcccaagttcttgcacgagggcgtctacgtctttgtctcgggcccctcgtacgagtccaaggccgagtgccggttcctgaagcagattggtgcggacgtcgtcggtatgtcgaccgtgcccgaggtcgtggtcgctcgtcactgtggcatcaaggtcgtcggcctcagcttggtcaccaaccgtgtcgtcgtccacaaagaggcccgttccgatcccgatgcccccgccgaggagagacccgtcgaggagaagattgccagccacgaggaggtcttggaggctgccgataaccgcgccaaggaccttcagaccttggtcaagcacttggtcgagatgatttaaaaagaaaaacgaatagcaacacgagcagaatgacgcctgtagacaaatatagaaacgattattacaacattattactgtcgcgtcccgaggctctgatgaggccagcagattgctccgggcagtaaggacacgacggtgcgactgtgtgacacacaaaccggtgcaagtagtggtatcattttagacggccacacgaacactgtcaacaatgtgatgttttcgccaaacgggcagaagatagtctcgggaagttctgacaagacggtgcggctttgggacaaccgaatcggaccacctggcgccatccttggaggacatgtcggcgaagtcaggagcgtgtcgttttcgccgaacggcaaacgcgcagcagatagcctcgggcagttccgacgagacggtacgactctgggacgtccgaaccggcgcacctggtgtcatccttagcggccattccgacggggtactgagcgtgtcgttttcgctaaatggccagcagctggcctcgggcagtcgatgaccaaacaatgcggctttgggatgtggaaacaggctggtgtctgagtgtcgtcaagcggtttcctggagcagttgcagccatcgcctggatcgctgatggacgcgacagctacctagcaacaggctgctacgatgattctgtgcgcgtatggaaaataacaggagaccgccatcacgtctgcccacagtggaattctggtcgtagtcaactttctacctcagatacaaatctccaaaacacgcgtggactgagcaggacgaacgtgaaattgttgcagcagggaggctccctgggcgatccagttcaaccctgtgatgacaccgaggacagttggtcattattcagcttggaggtagtgaccaaaaataaagcattctggttatcgcgtaagagaacaacgcgtgaagagcctgcaggcggctttaactggagcgctgggtatcttggctcgagcattggcgaaccactggccgactgcggctcgctcaggctgctgcactaaggtcaaacctcactctgctattggccaaaccgcactcttatgttcgaagtgtgtggtccgttgaagaccttctgaatacgaattggccggccgttgtttaagcctcggaatgattggcctatcaatagaatcgtgagaatctccagtttcgttcgtgctcgaagagcaaaggctgtcgggatcggcgaggaagagcgctatcattgttcttttttttttttctttcaaagtatttctcgctgctaaaaacaataactgtatcgcccactacatctaaagggggaaggcctcactcactcagtgttggagctaagcatcctggataggatcagcgtgctcgcgggtctcgaggacatggtgacccccagcccaatggttccgctctcgtcgacagtctgagcacccgagctactcctcgaatgatgatgcttctggcgttccggagagctcttgctctgctgcttcccatgtcggctctggtgcgggtgttgatgttgttgttgttgctggtaatggtgctggtgctggtggtaaggctgcggtgcgggatggtgcacctgtacgctactcttctgctgctcctgctccagcaaccattgttggtggtaaagccactcttgctcacgcgcctttccgaccctgctggcatacatctgatgctgttgctgatggtagtagtaatgccgtccaatgggtcgatgggcgatcgacgcaccaaagaacgagtcaatgtcgaaccaccgatcgggtaccatatccagatgtcggttcatcgccgaccggaatcgcttcctgtactgggcgggggacacaatcgtgggctctctcgatcccaccgcatccttcacccacgactccagcttcttgtcccacgtaaacggccggatgaaatcaacaattccgaccaagagctcctgctgcttatccgacactgcgaccaaaagtgagtagtccatgatattgaaccgctgcagaaacaacgaatcgtttgccagtgactcggacagctggagcttggcgtgctctcggatgtagaacggagactcggacatgaattcgataaagttttcatccagcaaaacttcattctcacgacccgacggctgcacgaatcggttacggcgcgagcctttcaggtcatacacttgcagactgcgacgttcgtaaaagagattttccataacaagaacgtccatgttcatcgatcgacccaaagcgccgtgcttgtaacccacgcggtagaatccgaagatcttggccagaacagtagggcgctacgcagggtgttcaaaataagaaaacgaaaaagagatggcagtgagcgcaacattctcagagaaacttgagactgttggcatgagaatgcatatgtcaactagtgcgtaccttgtgatagatagccttgtgcatgtactcaaagtaatgtggcgcaaacttgatgaaggcttcgagttcaacctttgagagctgtttcatgataaaacgatcatcccgggtcttgaggaacgcagatccagacttgcctcctgttgcatcccacttcatgcatcttgctagtgactggatgtaagaatactcgcaaccggcagccttacgcagcgcatgaaattgctccatgtagaaaatcttgcaatatagcatcgtcgagccatcgaggaacgctgttgtagcatatcgcacaacgtatgtaagattagaatcaaagagtcatttcttttttttctctttaacaaacaccacaaagatacaacgtgttcaaacacttacgaaacttcatgtgcgagcttctctcggaaagtaacgagtcgtcaaagacctgaatgtcatcatagatcccctcacttgctgacgcactggatgctgccatactgtttccagcaagagtgtcaatcgatccggcgaccgcactttcctcggcaggtgtggctgttccagaggttgacatgggagctgtcatgtcattgttgttgctcagatccgtcgactcgcctcggaagattcccttcagcttctcgacgtactgcggggaactcagcgtcagagcaacgatagaactgggttcatcttcacgggcaatgatttgtgagtattggaacacatgctcaaacggttgcctagaaggagcacacaaatgagtcgatactaaagtttgtcagctatgttcagatgatataataaaccgcaggaaagcggggcagagaatgcagcaagcacacaatcacacttacatcgggtacaccagtggagtgaagtttggagagttgcgatcttgccaaaagtttgagagcgttttgatcagcgagccgcgctccactccctcagcaacctcgctaagctgaggcagtttggaggctgcagccaacgcggcactcaaggtgcctgtgacagtcatattgacggaggaggacttgacaggcggcgatcctactgccgaagacatggcgctgccaaaggcgccactgcccaagcctggatagtgctggtggtggtgttgttgctgatccgtactgtaatcgtcctcgcctaaaaacatcatcatcactggatccagcacagcattgtcgtcaccgatgttcgactggacgactcctgaccctccgtttgcagtgttggctcgcatgttcgtgaaggttgtttccatgttgaacatgtcctctgtcccgagagcctcgtccatagcgtcggtctggatgagcgaaaaggtgtagccgcggctaggctggtatggctcgtcgccctcgccctcagactgatattcttcctcgtcatcggattcctccttggcagcctccttgacattcgcaaagacctcgatcgcaggcggtttcgtctccatttgtcgtgcatgacgatgattcaattgcgcattcataaatcgcgctcgtgcatttccgttcgatcctggcataggctgggtcaaggaccgggttctgttacccaccacgtttcgatgaggttcagaatgcgttgttgaactgtgtgccgctgtcggtataggaattcctccaccctgggcacgggccaaatactgtgactttctggcactgacgctcgttgccgagaggctggtattgccagaagagtgcggtcgttcctgatgcgtcgctgaagacagtgatagaggatgggaggatgtcgatggcgaagttccggtctcggtcggtcgccttacacgaggtttgttgaaaaagaacgggtttttgccggaggaggtggatgatgccgacgacggccgttctgtcgagggggttctatccagagaaataacgatcctttccttcgcacttgaaggcgaggcgtttccagggtgtaagtgcgacgttgaggggcttgatgctgcagccagaccacttctaggaagatatagattctccttgcgatcgtgctggtggtcataggtcggtgaagcacccatagacatgcgaccggtgaccctcgtggtcggacgggaggacactggaaggggtatccggggtataatgggtgccgttggcggctcctttgattttgtcttttcattcaggtcctcgtccgtcaccgtcaagatagagtccgaggtcatggtctgagtcagcttgggtctgaattcctgcatgaggttcatggagagtcggcgggtgaccttgggctccatgaacggaaacgagatctgggagcttgctgtctcgatcgcattctcaagcgctgctacatcggcctcctcgatttttggccttgcaaacttcagcgtcggtgaggttccgaggtagggcaggtcggacggggtagtgtctccctggtcatcgcatgtcgatcctccatcttcgctggtatcgagactcatgggcaaatccttcatcaggctcgcatgatgagctcggtccgacggtgcagggaattccttatcgtcaaacagccgacgcagcttggaagtcgtgctccgtctaaaatcgcggtccggattgaagtattcacgcgcaaagtctccaaaagtcttgtcccacatgacggctttttcgtacagcttaattcgcaccatgttcagcgccagggtgtctgtcggtgcactgttgagatatgtctgctgaaggagctgcaggatccactttctttccatcaccacctttcgattcatctccagaagctcctgcttggctgcctcaatcttggagggctgcaccacgtcgaaaatgcagttcttgatccgctccatgaccgagtcccaatagcgcgttatcagcgatcggaccaagtccaagtcctggtttttggtccgcgctgaaaattcgggcttgcatcggacgagcattgggggaaagttgatatcaaagagtcggatagggacgcgctcaatcttgacccgctgggtgtccaggccaaagtagcggatatggtcgcgattaatgtcgtgcgggcaaaggctggcgcgacagctcaagccggtctggtagaacaccagctctaaaaacttgccaaacgagtagttctgagtgtcgtccgagatgtacactggcggggtctctgcgtcgcaaagccggcattggctccacatcatgatagagtccctcttgacggtcgtcaacgagttccatggttccactgtgataacaaccttggtgtcgccatgagcatagatgcgttggtggtcgcggagtggccgatcgcaagaggtggcagtgcagacaaagttggagtcccaacatatctgatccaagtactgagcgagcgtgacgtctgtgttgatggtgtagtactgaatcaagcgcaccacgggtcccaagcaggttgtccttgtagttgtgcatacattcgagaacaggaatgccaggttctgataggtgtacggtgcaatcaggggtggtccgatgttgctgctcagaaattcctcccaagccttgctctttgcctggaaatcgttagaaatgtcgatataggatccttcgatgaagccgctgtcctgcgacctccccgtcgacgacttggtcatgatagcgtttgcacaggaagccgcaaagagaatcttggaatttccaatgtcccgtaaagcggtcggtgtggttgaagtctcgaactttttcagcctttctgcatcgacaatcatttctgtcaacaaaaagggtggtttgaacctgacaaagggcgatgcggaaagaattgtctgcttgtaaggtataagagactgttgtaaccggctgacatcggggtcagccgacatctctatcctctcttcctccgccagcttttgctccgagactgcagaggtcattgcaaactggtcgttcatgagggaagtctcgagtttgagattgtaagacacccagaccatgagctggacaactttcttgattctgttcagcgtctccatggagcctccacgaaggacaagtgagcaaaagaggtttcctgggcagtcttgaaagaacatgtagctcttcctcttgttgggaataagctcatgcacaaacgtcttgacctcaaatagaccacatgtgcctagccgaggagccttgacgagtttgtcgaccgagggaataaggtgggctcccgtggaatgtgcaatggcctccgtcacctcgggtttgacattgtatgcaaccgcgaccttgtgtttcagaagcaactccaatgccaggcgagacactgtcttctccacgacaataatgtggggactgagatgcatgattcggccgactaagagcgtcaaaaactccctttcctgactcacgatcggttccagagatataaagtggttttcgacacgctggtattccaaagcaaactgtaaaatcaggatccgggggttctggatggtacggctcatctgcttgtgagccaggtttttggtacagacaactccgttgatgtggagtgtatcctgagcggttccgccggggatcttcttgatcttgaccacttgcatcacgtccatgtttccgagcgtctggatggtgtttgacacctttaggaccagtttcatgatgacttcgtcccagcggtcggcattgtcgatttcgaagcgtttcagcaactggcgcagcagtcgacgcatatgctggagtgaagcgttgttcagctccacaacactcacagccacagacggtactctggaatgtctccctgcatgcaaaagtccctgcgacggaggttgtgctgagtacggtgatgacggccgctggtccatgggagatttcgcagactctgagccgtccgagcgcatcagcccacgggtcatgaggctgagactgaggttgcgactcggtcgcgtgccgttcacactgatgcgacgattgttgggcgagcgatccttggcaaacatgtctctcctctcctcgatccttgcgggtttctgtagcattttgtcccgtggtccatcctctataaactcgtcgtcgtcgctgctttcgccctgacctgagccatgaagtgtcatgaagcccattgtgtttggagactctggagcccaaaagtcgtcctgatcgtcgtcttcgtcctcgcccatgaaaggtgcaatttccgggtccagtaccgaatcagccagaccaccttcttcgaacgcgaacgatctacgaaacggggtcacgctgccatcgacctgttctccggccgttgtgtttgaacgcgatcttgctagaaacaggttggatcccgcatgtaggaatttacgaatgccctccagaggtgttccgtcgttgtgtgttgagccgatgctaggggacatgggtatctgttgagggaactgcccatgaatagcagctgttgtgggcgtcgaccacgaggatcctgcggcgtactcggcgggtccagtctcggactgctcatattgctgcatgatatccagacaataattgcacacgcgaagattgccctcatagccaagcttggcacccgggataatttttgaagcgcacttggagcagaagatatgtcctagaggagcggccatttgttgcaagtagagcttgcttagtctcgctattcataaacccatgcacgttgtcccaagggaagctactttgcaataatgtcctaccacagatacggcagtgatgctttctgcgaaggatgaaaaaagaggcgctgcagccgaagcattcctttgcattctcgtcagccatccaatagtctctgttcacgccctcgccgcgcagtcgccggatgacttttgtcagcgaattgcccttttgatgtccagaactgacgcttcgtattgatcgagcatccgaatcgtaggatggatcccgggcgccgagagtgtagtggagatagtccctcgatgccgagctgtcccctataaagatttcgcatccgtccttgctggttagagtggtcatttaaatcatgggcacgtgtggttcagcttccagtcagcctaaagcgtcctaactgacctgtgctgagcctcgtaggatcaaccatacggccgtcagggcttttgctcgtcatcgttccagaggaatcgtatggtccgccatcttttgaggtctgctgatcaccgaaggctgggctgagcgagacgactggcggtgcaagggatgccagcgaggccgtgtcatcgtcctgcacgatgctctggtcggccatgctgactctaaagagcgaggatgctctcttgggggcataggctggagaatagtgtcttctggcagcctgggatcggtccatcgcatcacttgctgatttcggcaagggtgcgacagcagcgtttggactgttactgccggctttggcgttgtcactggcattactgctggtcccatgtatggtactggagctgttgctggccccagcaccccatgatcccgcgtctgacattcccagaaaagtcgagccagctgtcgaggcggaggacgtggagcccgacttttcaggggcccggacagtcttttggtcagacgaggccgccgacacgacgagcgatggctggtaggtgttgctactcactgttgattgcaatgaggctgtgtttgctgcagagctgctcaatatctgggagctgtggccgaggctgtggccaggaggcggaggaagaggaggaagaggagggggcggaggcccagtcgtggctgtgtttggttgcggcagggtggaggaaagtgcggtcgaggtcgagagggtgcttttgacgcgctggaatatcttggagagcgcattctctggcgggtcgtctggcacggatggcggttcgtgcagggcatcgaagctggtgagcgcgctcatggcaaatgtgagggtggacagacagacagacagacagacagacgggcaagacgggcgcagcaggtgtgacaaaggccaccgggagcgagcgcgcgagacgggctggaggtgtgctcgccttgcgtggtgggatctagcggggcagacggggccaggcggggatgcgcggcagcatgggctggatgcagctggcagagtgtgcagggcgcgtgggcgagtgaggccagaaagaagcgcccttgtgactggagggccacgctgcccaatcaccaggggtgtgcaagtgcagtggttcctgtgcttgcacaagccactgcacactgcagtcgatcaggctgatcaacccgatggagaacgacgctcgacttcactccctgattgcatcctctcgctccctcactctccttttacttccaacagcacgaggcgggcccgtgtgcaacctagcagaacacaagggttcagatcgtgtcgctggcttcaaaggtgagtgccattcacaccgcctgttcagctcgatttggacaagccttcacccatccgtagctgacacggaatcgccttttttgggacttgccctacccacaggcctctctcccttcgccccttcacccccttcgctccatggtcactgccttctgcgtgcgttcctgctcctcggggcgctgggcactctccacggggagctcctccgcttgtgccgtggttgctgcccctcgctcttccagcgtgacagctttcgcatcaacccgcccaacgctccggaagcagtcgtgcggtcaaggaacgcgtagagcccagaccccttccatgccccagcagatgctcccgctgcacgaaggagcccctaaacggtctgtctcgtcgcctgccgcctatgctaaaggatccagatcaagtatgacatccgctgggcgaacgtaaacgtttgtgcgcctgcttttcaggggtaaacatttagaaggacactccaactcacctgcagatcttcttccacccactaattcttctcagggcattccagaaggcagtgtatggctctcatacccagatccatgcatattacttgcacaagcgatatagcctttgcctgctctcgtccctcctcgggcccagtgtccaggtccagagccttctcgccatcattacgctttcactcaacctcgtcatcggcagcatccgtgttaacagcgccaagagccacgatcattagcagcacacccgacgagaggaggatacggggaatgtccagcaggatatcgctcttgccgcagtggagctgttcctctgttcgtactcagatcacgcccatcgatgcagtatccattccccaaaccaggccattgcaccattgtcttgttcacctttacgaacagacacaggaacaaagcgacaaggtaccatcagcatcgccagtactcgaatcaaccatcaccagcgctttggacatctgcgcgctgcatcataaggaccttcagactgccgacttttccttcatcctagaagtaattcaagcgtattccaccagccagcaacagttttgggagtctgtcgcgagtctcgtccgatactccgtccctaatcaacggcggggtggagcggcagtgctgaatgagtggcagcgcacgatcgggtacgccatcacagaagtctcctggagccaggatgaaagtttatttctgcagcaggtggccaaggccatgggtcgtgtgccccaagtcgccggcgcggagctgcagtctcaacgatcgcacattagcacgcacgcacatcaccgagaggagaaattcacggatggggagatattagcacatgcgatgatcgagggcctattaggaatataccaataccgccgggcaatggatctgtacgagttgttactggagcaaggagtcgtgatttcaaggcagctgttgagaagtttcattcggatcgcggttcacaagggcgatggagcacagttggagcgaatcgggaaattggtcttgaggcaagaggacgcttacaagagctccgtggtaccaccgacgactgatgacagggctaaagaccagcgtctgctcatgtcggcaaggattatggactcgtttgtgtacggagcctgcgaacaccagctctatgacctcgccagggcagtattcgatcggggtctggcagctgggcaacactacaagatctcgaccttcactgcaatcctcaacacctattctgtcaaggagtttgggttcgatgttgttgcggctgcgatggcgctcggcgcggacagcagatctcacaaggatcatatcacacgcgcatccagacagggaggaaatcgtaccaacaaagttaaagcaaagattgacttgggggacaagaggatttcggtcgcggatcctgaggacatcgaaaagtacgtgcgggccatggaggatcagggggtgaagccggacatgacgaccctcaatgtactcgtcaagttgcatctcgaaatgtaccaataccgggtccacgggacgccccactggaggatggtctttcagagatacaaccccttgcaactgcagccagatactgtcaccaacaacacattgctggcctatcacgaaaagcgcaaggaccttgcagccatgaggaaaatctatgacagcatggcgggcgtacctgagactatggcagcaacgacgtcgaggcaaacgaggaagttgcatcgaatgcagcgcgccgaacaattcgacagtgacaacgatcatgatgagcaagagacgagcgacaagtatttatccgatcgacatcggccttccgcaaaggcacgccatgtccgatccaaccgcgacatttatacctacaacaccatgctccacgcactgctgcagcatgcggtggagagcaaagacatcgccgcgatcggacaatgctttcacgatatggagcaggacggcattacggcggacacggcgactttcaacaccaacatcttgtatcacatcagcaggaatgacctgatctcagctgtccaggtctttcgcagcatgaagggcgctgactcctccgcttctggagaagcaaacccgatccaattgcccaagccctcttcaggcgatcccctctcgagcgactactgggatgcagagtcgctccgctcctttgatgccttggatagccgattacctcccccctcgtcaaaacctgtcaagtcccgaccaacattggcgtcagctctccgccgccgtaatggctctgtccagactctagtgcaggatacaacactgtccacaggatctcagtccccgcaagtgccttcaccagctatggcgttcgatgctccatcagcccctgcaccagatatcgtcacgttaacagcgttgatcagtggatttgctcgtgcagacaacatggacaaggcgacccacttcttcaaagaaatgactgaacggtatcatctggaacccaacctcaagacgtactccacactggtggcggggcttcatcgtgctggtgaacacgagcgtgccgagaagctgtggggcattgttttggatgaagagaaggaatgtccgccagggttcgcaacagaggtctcagtccgtggtgtacctgacgatcgcgagtgcaaggtctcggagacagatttaaatgccgccaaggctgaacatttgagcaatgagacccttcaagaacagcagaggcgggtgcgccttcccacactgcagccagctgctcgacatttaaccatcatagagcgcctccaagcagagactcggaggagactctttagagagtcgttgaaggggtaataaaccgtccagttaactctcgagggaattcgatcacagttggattcagggctgcggttgagcgcctgtcgtgctcattgaccaaacgcagggcaacgctctctgttgagtacatgtgagtagtgtctctatgctataagacttgaacttgagtaatcaggacctgggtctggtatggtgctttcgtgctaatcgctgtctcggtcggattgtctgaacacattgcaacgctgtagtggccagtatcccccgtctgggtcttagaatcgccctgttctgagaacatggtatttttatccttgggctcccctcagccgcatctctgtacccaggcaaagtgggtcaggaacggcggaaccaagaccttgaaaccgcgcgaggagcggcatgtatgcagccactcgtgcatgaatacggaatggccgctcggcatattagacaatgtttcttttcgcggagtacatctttgcgacaacagggatggacacgtacacacgtggctgtaggtacctacaagtaagtcttatcccaactgcatcctccagtagtgtacagtggtatggcatactatatacatacaatgtgtagtttggtatgcgttgaatgacatacaatgtgtagtttggtatgcgttgaatgatgaaagcaggacagactcttggactacagttattgtttagttttacacgtctcgcaagatatctacctactggttgatggcatggctccgaatctcaggcgacaaagttgagagcacacaggctgacatcaatctgctgatgatcgaaaggtccgtcagcacgcagctacttatacaaactttttccctgtctgactgatgaaaaaaaaaagctcctcacctagtctagccgtgtttcttgcagttccaaaggattgcccgcaggaacgcacagtggagtgaattagggagggaaggcgggagggacggaaggaaggaaggaggggctaaaaaaaagggccaaaggggtgatgaaaacaaccctccaagaaaggaggcacgccgactgttgcctacacgggtggatcgctcatcagcaaaggagagaagaccaagacgatacacaatgcaactgtacaacagtgcggtcacatcgctcgcatgtgttgtagtacaaaagtccaccctcggtaaacataccggaaaggcactgaaccttgtatttgtccacttcatgtgcaattggtcttgccccagtgctctcctctttttttttcttggctctcctgtggaggctcttctgcagaaggctccgctttctgcggtgatctggaaatagaagtgctactcctttcgatcatttagcagggctcggagcggtctttccccccgcgttttctggtaatctcaagaacaataaaaaggctgcacaaatcccgctcttctcttctaccgcacgtccactttagcaccaaccttttttttaatgcgtttctacctccttcccggcctcttggctgtaatctctggcgctcttgcagatggtaagtgtgaacttccccttccagtatagcctagagcacgcacatgcatacgcacagcacacgcacacccacacccacacccacacagctccttcccctaacaccttccctcgtcacgtctctcctacagtcacctacaacgtcatcggagccaatatcacagacggcaactcgttaggtgtctcagtgaacggcaaaactacgaaactcaccaccagcgatgagaccttcccgctgtggtctgggaaggtcgctggagtcactgcatcctccaagtaccgttatgtcgtggtcggagctgatggcaaagatagtgagaaggagtatttctcgcgctcctttgccaacactggagatactgccaccgtcaacgaaatttacatgcgcaagccaaccaaaggtctcaagacactcccccaggtctacaaagatgttcgtcccaagccttcgaatgcctttgacgacgaccaggttggcgtaattcatatggaggccgaccccgccgcgtttgccgatatgatggccaatccattggatgaggagagaaaagccatcaaagccaaattcatctatgtcaatgaccacatgatgtacaccgccaaggaggtcaagctcaagatctctggccacggatcaagaaagttcaagaaagtgtcgctcagaatcaaatttgacgaggaaaagggagagaatttcttcaaccggcccatcatcaagctccgttcctcaagcaatgaccccacccagatgcgcgagaagttgtactttgacgccctgaacgcggtcggcgtccctacagcgcagggtgcgtacgtgcgcgtctatgtgaacaagaagccctacggattctgtctgatggcagaggacattgagacgccatacatccgaaacaccattcacggtggcagcctcgagtacaaccagctgggctctctctaccagatgggctcgcatgtcatcaattatgaggcaacgcttctgtacactggctccaggagcgcggattatcacccagagatttattcaaacaagaacctgggagaccctactaagaacaccaaggaggagccaatgactcagttgattgcgttcctgaaggatctttacgagtacgatccctcaatggccggcggcgagaagttttggagatcccgtttggacctagatggcttcttgcgcagtatggccttggaatatcttggcggtgcctgggactcttactggtggaagggcaataactacttcatgtacttcaaccctaccaagaacgtctggcaattcctccccacggactttgattccaccttcagcgacggcgcgcgtgcagatgtaaatgtcgtttacaagcagtttgccgccagcagactccgcagggccggaaaggaccatcccctgatctccaaggtcatctacaagaacaccgaaaccaacaagctctttgagaagactcttcttgagatcactcagaagttgttcaaccctactgtccttaaccccagaatcgacactatcaaggcgatgatcagggatgatgtcaggtgggactactcaatcgatcgatccgcaagacccggcaaggacccgaagtggaccttggcactctttgaccagagcatcatcggccctgtcacaggcatcagccatggtatcaagccttggatcaagaacagggctagcagtgttcccaagcagatctctgcgtaaaagcgtgacgccctggtctcttgcgagacttgtgggattatctctgctcatcatcgacaaagttggattgggggaactgggaattctggaggagcatgggccttctcagttgtggaagagctggctggttcttgcaacgcccatatatgtttctgacgaggctgctcttctagttccttcaaccacaccaaaactccgcaccgttgcagttgtagagttctcatgcacgcatgcatccattcacatcagctcccctactagagtagtataccccccaccttaatgacccacttataaatttttcaacgttcatatgttattgcagcgatgccatcgaaagagcaaaggaacatgcaaggcgcttgcgagacaggcctaggttcgtcaattttatgttcacttttttcttctccacattccccttagctcacaaaaacattcgtctctacttatccaatggatcagttctgggtaaagacaatttgtaagcaaacgttcaatggctgcatgtattcgtaaacttgagccgctacaaaaggagcagctctcactttctcattttcaattggtacactgccatggttcaacacgagcgtaccgatatccgcaaccaaaaaccattcatgaccaatccttgaaaaaaaaaaaagtcgccacaccaagatccagttagagaacatgctttttattttcaagagtaggcacattttaggagaaacccccatcggttgagtaataaagtggtttgaaccattcaacaccaagggggttactggttcaaaatgacagccgatggatgcttggtccctggatagcacatgttgcgggtccatgacaaacaatcgatcgctggagagtacccagtcaactcgcgacaaacaacgaccctccaaaagttttacacacgagaaaaagaaaaaaaaaagttttggtagtagaaacaccgaggagtatgatctagcaaaaaccagacgggtttaacgatggtcacggtacagtcgagctgcaatagatgttccaatggcttgaaaagcgcttgcttaccttcctcggttttcgatcctcgatgctctgccaaattctagcttgatgaacggtgtagagtgctggcaagtgaaagacgtgaaaatgaaaatgaaaattgtctagttgaattcctgaagtccccataaccttaagtgtcccatttgcacaacaggatatctgcgcgaattcacacctcggtagctccttcgtcatgagatcgcgacagaggatgtgacagccgtgaatgggacggtgaaaagattctagttaggggtcctgctggttgtccttgcagttgcgtgcgaagtataagaggatttgggacccatgtcgcgtatggacattgattgtgaagaatctatgagaccatgggcgggaagatcaagactcgagccgccgttcattgagattgaccttgtgttcccgaattgcttgagacgactgctggagacatggcacacatcgctgccgctcaatgagtggagcatgtgcagaaagagatcccttgatggtggcgatagtggtgacagcgcacgaaacgcaacccacgtggcaagataaataatcttgattccgcatggccatatcggaggcaagtatgtcggtttttatatagtgctccagatgaaaatacaaaatgtcagacttatgtcgctatgcctcgccggcctggtgggctagtctaaagaagagggattcgctgttctcaagcaattttccaggcgagtcaaactcctgaactctgcctctctccaagaccagaatcttgtcggagtctgtcaccgtttttatgcgatgtgcgattgtgagaattgtcctgtctttgaactctgtgcggattgtcctctgaatcagttcgtctgtttccacatctaccgccgccgtagcctcgtccatcactaggatcttggtctttcgaagcagcgcccttgcaaggcagatcaaagaacgctgtcccaccgaaaagttttcgccgttctgcgacacctcaaagtggagtccgccaggcaacatagagatgtacgacttcaaatgagacctttccaaggcttgccacagttccgcatcgtccagttcttggaagggatccaagttatctcgcacggtgccggcaaacagcgttgggtcctgaggaataatggacaggtgctgcctcagctgttgaagacccacggttgaaatatccacgccatcaatttcaatccttccaccatcttcctcctcctcattagggccgtgctgagtttcactgtcgtggtcttcctgtaccccaaagtccataacggccgcatcactattgtcactttcgcgagcccagtagctgttggctgcctccacaatccgaaacaacgccagagtgagagacgactttccagcgcctgttctaccgacaattccgaccttctccgctggcgatatcactagagtgacattcttgatgactaaatcaaggccctcccggtatcgtgtcgagtaattgtgaaagctgatccgaccttctgctggccaattgggtggtagatggatgtcagtgacatctggcgcctcagtcctgagctccgtgtactccaaaactcgctccaggcttacaagttgattcttgaatatggagaataaacatggagtcagtcacgtttgccttgaaacgatatgaagaaaaagaccacgacgatgatgcttggacatacctgcagatcacaaaagttccgtacaagagtcgtcacttcttccgtcaacgttaacgcaaagcttaacgacaatcccaccaaactcggatccaaatgctcccgctgaaacactgcaaagacggcagcacagagaagcacgattgtactcaacagccttaattgcacatccagccatcggcgactcgacatgttggagagaaaattgttggacatcctgtctgtcaaagctacacacttctcagcaaaccggtccgagactcccatagcccgaatagtcgatacgccgtccaaggactcgttaaaatactgataaaccggcgatttggaaacggaatagatccgcaccaaaatccgcgatactcctagaaagcacatctgcacgtaccagtatccagctatgaggaacgggagtaggaaggtaaacatcggtgtggtaaagacgatcaagagtaaagtggaggaaactgatatgccaaagaggagaacatccatcaacttgttcggaatccggatgtcaacagcaaagatgtcagatgagaagcggttgactagaaagagacaacatcacccatacaagactcgttagtgtcgatccaaaattgggcatagccatctgatccactcggtacattggttcaaacggcgtgggaaactgaggacttactgatcctgccgagtggtgtagtgtcaaagaaagatattggcaagcgtagaatcttatcgagaagtcgagcgtggattttctcagacgcctgtatccttgcaacagcaaatccgagccacatgacgaccacatagatcagcacgtagacaaaggtaagagccccgtagacgccaagaaataaagcaagcgacggcgggttgtcatcgtttgagctcttggtgactttgatccagtgcctgagccagaggctggtggatacaaggcacccttgagcgagcaggaacagaatgaaaataaaagccgcgttgcgatacgatctatgtgtatgaatatccggtcagtaagcgatgttcgactgcattcagcgctgccatgtgccaatggacacgggtgacttacgcagcttccgcataggcaaggacgatatccgcccccacatcgccttgagctattgtttccgccacaatgagagccgccttggtgtctttcttctcatccttaatcgactgtcgagtagttgtttctgaggcttctccttgcagtgtccattgatctgtggctacctcctcagcgctctgctggcggtcgtcgttgttatcctcttggctgtcatcgtccagagcaccgctctcgccagcgccgctgtcttggctgcttctcctctccaatggcaacgccgaatgtgacctcctgcgctcgagcatggtataatccttaatcagcgtatagaacgctcttctgcctgccataagttcaacataagtccctttctctgcgacgaggccatccttgagtaccacaatttggtccacttcctgtaaatgatggatcccgtgggtcaccaagatccgagtcttgtcgttaagcaggccggatggaccaagaagctcgtcccacaagtgtctgtccacatgcgcatcaactgcacttagagggtcgtctagcaagtaaatatgagcgtctgcgtaggctgctcgggctagagacactcgttgcttctgccctcccgaaaggttgatacctctctctccaatttcggtagcatctctaacattgaatgaaaaaaaagtcgaagagattctgagtcaacagtgcctttcgcatggaaaatacacgctgtcagtttcgagatgaacccttccgcatggattaccctgcaggcagcatcgcgagatcgggttccagtccacatgcacacagaacctgcttgtaccgagtctcgttgtactctgttccaaacaatacattgtctcggagtgatgcattggtgatccatgcttgctgtggtacataggccacccggcccgagatctggaccctgccatccagtttgtacatatcgccgataatggcactcaacagtgatgatttgccttggcccacccgccctacaactgccgtcagacttcccctgccaaccgtaagattgattgatgataatgtcggtacagttggatcctgtgattgatggtccgactcttcgagtaaggccgtcctttcatccggggccgtccttagcatctccttcactggagtcggcccagtccaggaaaacgtagcgtccacgagtgagatgacgggatcgcggttgtctccaggcaagccatcaaagcgcagtacatcctgctcgttcacctcctcccgcatcaagaactgttgtatacgcttcgttgccaccaccaaactgatcgtcgtggtcgttgcatcggacagactggagattgggttcctcaacattgcaaacagtgtcatcgagacaaagaccgtctgcggcgtcagttttccaggcgtcattcctggtcctccccacagcgtgtagaccgcgaacgtgatcagacttatgatgagcgaagacgagataaacacaatcgacatgaacgcctggacgatcccgagtttcctgagcgcctccaattccatttgccgtatgcttaaaatgcgtttcaagaacgcgctggaccatccatacagcttgacaatcttcatcgacccaagtatctccgtcgttagccggatccgttggtccatcgccttcagtttcttgtgctgcatgctctcgtagatccgggcctgccacgcctgcagaggcaacattagcaccatcaccagcacgccagccaacatcgtccaacccaaaagaccgtacaagagtctcatggcgataaagatctctattgggatggtgatccacgtcgataggggtaccaagcaatcccaaaagacgtcggcatccacagacatgtggtttgcaatctctccgctagtggactctgttcgcgatcctggcgacagtcggagcgcctttcgataaatcatggagatgagtgctgcccggtaggtgacgccgatggtgagcatttggtaccgattgtaggtgttgaggagcgatgcaaacagagaggcgacaaacattcccactgcaagggtgagaccataggacacaggtttggactcgtaatcctccaggtagccgagcaactccctcagtaaaatcgggagagtatacgagaatagcacgatggcgatacgactcatgaggacaggaatcagcaactcccagtctttgatgaggatcgtccacagcaaagaaggctggtccgcgaattttcggtgcttctttagacggttgctccatgcgcgtgaaagactcctgaagcctcgttcggctgacatggattccggtagttgtcccatgatatcctgctgggtgagaggtcgccgtagtccaatagcaatgatgggctgaaagaagaaaaaagtgaggcgggaaaacaagttggcccggccgtacaagctggcgccgctcctctgctgaacttgagtgcgtcctctgggccacgcctcgagcacgaatccggctgctaagatcgatgtgaatactgtcagcagcttgaggatggatccaaagatcggttccagatccagggcagtgttgataatggttaaagaggccgcaagggcggctgtgtagaatgagaaaatggcgcttgacgaccggatctcgtagatatgctcaaaatgattcaagatcattgccagggcctatcgagcaaggacacaatgtatgagcaggtgtcaacaggcggatataacttcgaagagaaactgtatgtcctcagtgtcaaaggacattccttacccatgctgcacccattgacaagcagctccaggaaaagattggcgatgagttctcagacgaaaaatgcgcggtcgataacgtgcaggccataagcgctccgagtcccatgcagagttgcgtcggccaatagatccaagcagttcttccgaaattatgtgcctttgcatggtgagtcaggtagtatatccgtatggtgaacccgagaatggcgatcagggacacggcgccaaagaggacactagcgtcgcaggggggcgggaatcgactcatcaaatcagcaaatggtgtcatggcccaataatgacaatgatagggaagtgctgaacgcctgttgcttcatcccgcccaaggcgctgttatcgtcatacctgtactcgaaacatggggtcagatcgtaccgacttggactcagcggaccctttagatcatgcagagagcaagtgagtgatgaggaatggaagaaaagaagcttgggcatcgtcctgagtactcaatggcggacgccggggccgtcagcgagacttacccagccttcggcgtgtttgcaaaggtcacttgtcctgggtacgttgcttccaaggcgatgcccaggggcctggtacggccaggactctgatgccagtccttggctttgcatcggttggttcgaataccgaggatagctttccttgacagaggtaactctggaagttatagccagggggtagtgagtggtggtcaacggaagaagtgcaaaaaaaaaatatataaaaaaaaaagtcaagtcgaaagaaaaggggataaacacacagaatacggtttcccgcttggccctgggtttccacttcccaggagccctcgtcgtccgcgattgcagcagcagcaatgctcccctggtggactgccaccgcacaggcacacagtgcggcgtgtcagcaaatgtacattcttgacatgggtgtgcgcatcatgatccagctctggaatggaatgggtcgtggagcggcgcacacctgggcgcacggtgactgccaccggataaacctcttgcgcacgacgtttttcgttcacgctaccgcagatcactcttattgcgctatcgagaatatctagtctattatacactggtcatcgccctggatctctggaggagcaggagggggaggcaagggcccatgctgtgagttgggatcgctcacaccctgcgaaggctgttcgcagttggccatgcagtcctcgtactcattatggcagtgtcgcgcaaatcgctcgcgacaggtatccccgcgacgaccgctgacttgacatactcgatagtattgtaatcggcagtcgtaaaagtcatcgatacacaatgtgcatgaggtttggtccggctggaagtcaccttcgttcaacgagggtgggtctgtcctcataccgggcgcggtatcgtggaaaggagatgcggctgattccggtgtgctggtcgcacttcctaatacggctgactggagtccgcaagcgttatttggaatatcctctgccgttgccgagttaataaacaagtctcctgttgaaaacgaaacgacaagcaggaggggaaaggtattggccagggaaaagaatcgcatgttacgaccatctatgcgagcggaggaggatcgtcgatggtataggcaagaaggacgaatgtaggatggcaaagggaaacaagggctgtgcagatcgagccttcgtgatcgaccctatttgggccattatttcaagacacaacagatgatagatctgtttcgaacaaggacgttccaagttgcacgggcttgggtccataagttacaccacaggaaaaaaaagagggaaaaggaaaaggaaacggagagggaaagaggaaaagcaaagggggagatggatcttttgcgggttatttttttgcgtcagagaaaagaatggagtttattgtggtcgatatagccattagttgaagaggaagcaaagtgctttgttttatcgccgtcgagatacgatgctttctgcgagcgccagaacggttccagtgccagaggtagccaagcccaagctggctggcacataacggaagacctcagccaagtacttgcatccttcccaaagagtatgatgatggtggtggtgaccggcagccgcctctttggcgaggcttgccatcccacccaaggcatgggcatgagtcgccgactggctcaaaaaataggtcagtgcgaacttgaacacaaagaacgaaaggccggaggtggtcttgcgcgccaaaaggccagtgacaggtggctcgtggtgatggtcatcttctcttgggcgctgtttactagctcggtcgacattgaacagctgagacagaagggtgggaatgataaagagggtaccatagtacgagaagaacggcctcaaaaagttgtcccagttggcgagaaagtgaagacacgatagccagttattggtgtcctattcaaggtgtcaaagcaaactgtcagaaacctagtccacgtttccattgcagaagtaccaatgcaaagtcaagcgttcccttacatagtcatggccatgctgagagtgggcggcagaggtaaaaacgataagctcgagcacgaacgtgatccacacatagcccaagctggaggagccaaggtcatgcagcctttcccagttgcgtgacatgcacgtcgaaaacccacaggcgcctacgcagtccgtgaaccgatgcctcacctcgccgacaacccaactacaccatccttgttcctcatgtccgtgatggcggtgatgacgatgacggctgcgaccatggcgtcccacatcctcgtcgtcatcgtcctcgttgtcatggtgacgagaaccgcgacgaaagcctctgcgagcacccagtccacccacagagtcaacaacgtcgtcaaccgcatgggtgaccgaggaggtaaggtccctcgaagcgcgttggagcgaagccttaccggactggaacttgtcgtgaagcgtatgttccaaatgctgcgccttctccttggcctgatgcaagtccgtctgcatattgtccataaagttgcgaacttgctgcactgacagcgggtcttctgcactgtccgagtccgtttcgtttctgctcgtcaacattgaaaactcaaagtcaactaccgttatacgatgtcagcaagctttgtaaatcaagtacaagtattcttttgttaccttgcaacagtccttttttttgtaggcgaagaccgcatgctgcgtgtatgggttccactgtctgaggtgtcgtcctcgttggcggacgataaatgtgctaaacgagcactctcagtagagcgacgactggttctggagctgtcatcgcggacgagatctcgaagagacggatcagacgtgccgtgcttggcaacatggagtctgccaccgtggaaaatgcagagggagggggagaaggttagggttttgcattagctatgtcttaacgcaagcgagtctgtgcagcggcattccgtacttgattctgtccgcgagggattctcgagagccctcgttggaaaggcccaggttactggcgagttctaaggtgggacagaacagatcgagaccatgagcaacgaaccgcaggaggcgtttgcaacgaagaaggcaaaatgcaccgcacagacacttacccttcaactcgtgtttgcggcgcttgtaaagagcggtcgccatggtttgcgatgggtgctgactgtcgggcgcttcagatggggttgcgagaatggggttggtttctttatctcaaggaagcggtgtcggctacggacgtgggaagtgcgaagagggcagcaagagggaagcagaggacagacggagagagacacaccaggtggccacgcaggggagagacagattcgaaaaaagttgtgaaacacccacggtcatggtggtgtcatcgccaaccagcctggccggtgtgagagggcatgttttcgattgacacggctcaagagacgcgattttttttttattttctttctatcagggagacgcgagcctaggcgatccggagagtctcttggatgtacagcctcgtttcctcagaaaggtcgctcgctatggatgcaaattagaacgatagtgttaggcattgagtcctgttctgttcaagtaaagataagctgtctgcgacaagtcagggtctgtcttaccttgacaacaagacttcacggccgccagcagcggcacctgcttctgatcagccttgtccttctttctttgtggctctgaacccaagccgaaagttaaatcggattctacaaccccgctataaaagacaatctcaatagctcgcctctgcagcgcaggcggcagccttacgaagggtcccatcaccgtcctcttcccaccctcctctcccttagcagcaactgtcacacaaaagaaaagagccatgtatgactgcagggttttcaagaactgaacacgctctgcgtcgttcgctgcttgggctcgactctcgcctgcaatgatcgccacccaggccagaaggtccagggttgtttggctggtctcaatactctcggtgccgagatcccacagaagcttagggagtttcaaaagacttgacgaaaacagtttggagagctttgcgattgaagcctgctgctctctgcggtccctcttggaaagtcccatcagagtcttgttgacagctcctgcatgtgcgccagggaccatgatagtgaacgagccagtgtaatgcggatgcgattgcaactaaatgtcaaaagaaaaaacggtacggatggttagcatcgtccccttctaggattatagcccaagatggttacatgactaatcaagggaggccttctacaactcaccttgacgacaagtgccaagaactggagtacggtcctcttggatccactttggtcatgagcattatcgaagaatgccatcaatgcctcgaaaacatactccctgcgactagtctcgaggcagttgagcagagtccagagtgtaggcaagagtgcgacaagatgcttcgatttgaagtcggttgagaggctcgtcatgagtgatgctgatacagtgccgtcctcctcgtcctcctcgtcctccttgtcaggtctctcccatcccagagtgtccagaacaaagtcgacaacttgatccgcccacgcaggtgtttcaacctgcattgtcaccatgttgctttttttccgggcctccttttcccgctggtcctcttcatcctcctcgctgtcataatctgaagatgacgaggacgactccacaaccacatgattctttttagcagatttgttcgatggacggtacgaggacttgacagtcggcttttttgactttgacgcgctgctggcctcctgggtccgatgcgacttttgcaggctgtccttgtgcacacgacgtatccgtcccacgccagagccgagaaggaaaagcgaagtcagctcgcagtacgtcgtgttcatatcttgcaagagcgctgcgacctatatgcacaaagttgcatggaattggttaacaggaatgccaaggggcacgcaaagaaatagcgtcttcgtttttgtacataccttgctgtctgttacaccgacagtgtcctttccaaatggaaaatagatgagcacatgtcggagcaagctctgcagatactcatcaagccacttttcctcttccctcccgcgttcccgctcctcatccgtatccgcgcttttcgcctttggccgggcaagagcggccctccataggataccccaaatctttagcaccaagtgaacgatggtcagagcatggttggcatgtatcgcagtcgtcgaagcaaagactgtgggcgcagtgtccagccatatcgagagtaatagtgggtgaagggtcgagatcaagggcttgatctgggccaatcgaccctgaacacctccgaggttgtctccgcctttgactccgctgccgctaactccagcatttgctcccgctccggatgcgctggcgcccccttgctgaggaaatatcttgatgggaatgtttgtgggtgctgtggggtcgttgtctgcgctttgtaactcgccccagatgacctgggtcatggacgactggatagccgagggatgaagagggaaggtgctcaaaagctgctggagggcgctggccttgttgaaggagacgactggggcgggattaagggcgtatgattcttccgggtcgtaatgcctttcgcccgtgctctgtacttcatcctcatcctctgacgacccgctctcgtcttcactactctcatcatcagattcatcactcgtatcggctttcctgcgcactgcacggccagaggagccatccgatgtcttggagttggatgcttttcgcttcttgctgcccttgatgagtccctcatgtgctcctagctgcgtcctggctgtgttgaatgattttcttgcgtgtgcagtgcccaagaagtttctcagaaaccaatacgggtccttatcgcctccctcgcccccaaggccctcctgcaagaaacccgccaaactttgaagaacgtcgctcttggccttcattgatccaggagcattctttcctgtgctggctcctgccactgttttcgatgtaacagctgttgttcctgacccaccgaccatcccgctgcctgcagaggctgtaaatgacattgcactggagagtttggatgcgttggtggcgttggagtcggaggtcaagagcgagacataattgggaacgatctatgaatagtgtggccttatgttagtccatgatgtttgacgccctgaaataggataccacgatacaagccaaacacgtaatcttactttgtcccagaacccgttcacgacaatctgtccgccagcagcgacccacagatccatgaactttaacgcatcctcgcggatatcctcaagaatatgagtcattgctgagcaggtgtacacgatcagcagcggtaggaaggggtgaatgtcacgagcgtggagcatggggatgaattctcccaaaaaagtctgcagtgcctttcgaacaacactagactgcaataagaagccgcggctcgttagtgaaatgttcaaatctcctgtagtcagccgcacgcatagaggtgtgatgataggaacctacatcatcgatcaagagccggacgatcgagttgacaagcacgccaaggtgtagtggcaagaggtgggagtggcggtgaaaaagatcacgaagacccaggagcgcgtccttgcgggttcccgggctgtagtgcttcaattgcgtcatgagctctgcaaaggtgacattgcgcgagttggtgagagctgcggtcttgtcgtgactgatagattgactaggcagcgagatggctgtgttacatcgaagagtgatgatctttgttagtatgaaccagaagatgcaacagcaccgacgcatcgaagcaggagacaggttggcgcaccttttgacttgaatgatgtgtctgtgaagctatcggcgacagccttcttctttccaaccttgagtttggttttctataggtgatccgcgatacaagacaccagcactattaggtcaggaggccaacgaccgctgcatggtgcccttgcaacactgaaggacaaggactggcagggatgcattgcaggtttgctacccaccttgaagtcggcattcttttcctttttccgtttgctgcttgattttggcatgtcggtgatggcaggggtgttgagtgaggtactgttgctgttgacggaatgggaggctagggccaagtgttctttttttttttcgcgagagaagtgactgctaactttactgtaaacaaacaaatagttttttttctttttccttcacacttataatcctgcccactccaactcccatccatttcttttctttcttctctcccccaccacccacctcttgacccatcacccccctatacatcactacaatggtgagttcccataccctggtgtgcttatatcgcactgcacacagcgatgactcttcacagcccgtgttttacgtggctctgcacggatctgatttgcactcttgtgctgccaagtgctcgtcgctcttctgaccattctgatcttgtattttcctcaacttttaggccgaatccaaccctaaagcctggcctcttgccgacgccgctctcaccaactcgatcatggatttggttcagcaggcttcccactacaagcagctcaagaagggcgctaacgaggccaccaagaccctcaaccgtggtatctccgagttcattgtcatgaccgctgacactgagcccattgagatcttgctccacttgccccttctctgcgaggacaagaacgtcccctacgtctttgttccctccaagaccgctctcggccgcgcctgcggtgtctcccgccccgtcatcgccgcctccgtcacctccaacgagggttccgacctcaaggcccagatcttggctatcaagctccagatcgagaagttgttgatctaaatcagaaaaatataactttcctcgacgtctttgcatttttcaacatctgtgctgaagtccttcctccaccctttaacttgttctttctaatgatgcacactgtcaactcttttcatttcccacctccttctcctagtttttcgcacagtgtacaatagcccatcttttgcatcctcctcatttttttttctttttctctggatttctcgggatcttgttacccttttcctaaagacatgatattaaaaaaaagtgaagaagtttagaaagattttttgcgtatccatagggattgtaactgttgcactgacccaccaattcgaaaattggaaaaagtattgaacgtgtcaaagtgtctctgcaatgctctcctctgactttcaggtcaatggatacatggatcacaatcctttcctcttacaccacattccgatacctcagttgggggagcgcaaggccaaggaagcaagatactttagacaagggagcgcatggccaaggcagcaaaatgatgggtgagaagtgtggatgatggaatcatgtttatttagatattgccccaagtcaggcgcatgacatggtccgttttccgattcgttggcttgataaagcccatgaactgcagctctgccacgccgctgataaaccgtgcctgaatctccttctgatccagccccgactctttctcatcagtgctcgctcgctttgctgccgtcgccttgggcttccctttggcgccccgactctttgttgtactagaaactccactgactttatcgccactgctgtcctgatccctctttaaacctcgctcgagaatcatgccaaacgcggtaaaccagtcgtacatgttgatcaaccgcccgcattcgacatagagtttgtacaggatacaggtgtcatgttgtgtcggaaggaccatgtcagcgagcgatgtccttgtgcgctccgtaccctttggcggatggcagcaagcgcaattgaggtagagttccggttgaccgagtgctgtttggatggatgcgcgaggttggggtagaaacgcctaagagtcatgaccgggtccacgttagatcaagacaagtagtaggcacgagtcgcttcaagtcacgcaaattggcacataccttttgctgaatagtcagttgagaataatagaagatttcgttcagcggcatgcgcgtgtggcaatccagatatgtcctatagcgagcacacatgcaagcatcaataaaagtttgcaacaggcaggttcgcggtcatggctagtgaagggataaaaggcatctacctgagaatcctcccgatggtctcgtcaacctcggtcaccaaaagcgtatacgctcccaaagcgcctttcggcagccttgcggtgtctcttgacttcttggcaatctttgtctgtcggctttctgtgtcattggccttcagactgatcagctttctcttctttacaaacgttgagttccccgttgattcgcgctgaggccttccgttaaccatccgctgtgctttgttttgaacgtggccaagttcgtcaccagctgcatcgttgtcttcaatctcactgctgctcgttacagagtcttcactgacaacgtctagaagcgcggccatcctatcccggatgctctggatcaataatagctccttttccatcgagttttcctggtcgggcgatcctggcaaggtgcaacgaggagcctgcttgaagacttgaagccagtcctcgacaaacaacatcatgtcgttcgaattcaattttctagaaaaaaaaaattccatggccggtccggtcagtaaaagagggtcattatacttcgatgagatttaacggcgtaaacactcattagttgatggtgtatatcctcaccttatcagtcccaaaaggaaggtaagagtgcttgacgtcgtcagagacccatcaagtgccatgaaatacaaggctcgtttggactttttgagcactgagatgggaaatcgcgactgtaaaaaccatagaaagtcaaagacgaatgcaaagtttctatggtactcttgtaggtcattagccaagtctggaatttgaagagccaggaactcgtcgtccatgagaagcatttctgctgtttgagaatcactctctactttggattcgacgtatctactttgacgagggctttcgttagcaatttgttcctgttcctccaaacaatcagccaattattgctgtcactcaaagggctgtgaacttactgttggaacgaaggcagcatccggatgtggtcatagtgtcccttgcccagaagctcaagcgctctactttgcgctgtcagcgatctgtcgcagagtatgctcagaggattcgcatagtaatgatgcattaccacgtactatggcagagagtcatcaccaacctttgtcagtcttccttagtccatgctgttgtatccgctagccaccgctctatttcctaccacctcttaccttgagattggagacgaatcctccgacggaaaagttgtagtgaatgaattggtcaattagctgcttcagtggcaacggtccgaccataagtcccacgttcgcatgtatgaacaaatcctccacgatcgccgtcaagcattcggaggactgttgcatctgaaatgttttcgtccgcagcaaactgagtacagatttcggcagcccttgatgtagagcgtcaatagaagtggcgagacccagcagtagcacgaacggtatccgatcctggtaattactgcagatcgtgatgaggtcttgaagtgtgtcctgatcgaagctttcaaaatcctgaataatgaccacaagtgctggcctctgatctctttgttcgtgctggagttcgacaatgctctggtaccatcgttccaacactaccatatcatagttttgaagtttcatgccaccctgtcgatatcgcatccccaagatatgtgttagtctaattagcaagcgcctgactactgtagatggaagtgatcacaagatctgacactcacctctaacggattgattgtaccagcaactccaagtcctagaaactgctcaatcatacacttcaatgcgctcttcaggttggcacaatccttggattgaaggatgacaacatggttccttgtgccttcattgaccagtttgtcattcgaggtcttgctttgctgttcaagcgactccaaagtaggttcggctggcgaggtgagcgttcgagcgatctgttgaaacatgagatcgtggtcgggaacgttgataccagcgaaaatcagtcctgctggcaactcctgtactggcatgacagcactttagaggagagatgttaaacctgcggttagaaatcgcccgtatccctcaaagatattctccatgggtcttcagcccataccttgttgctagtggggtataagcgctttcaacaaagcggtagatcgccgagaggactatcgcgttcatcttgagcatcacatcctgacaaagcaatgctacctgttagagctgggtgatgtctgcttgtcaaatcccgctgagcaagagacttctcctacctctatccttgaagacatgagctcccattccttgttgaacaatgcgtgtctgatctcggtcgcctcccagggctcgtccacatcctgaagctgttggaatccatccagtttgaaatgaactaaaagtgtgtgtgcaaatgggcgttgttaaaaaaagagcactcgagttgcttcgacattggtggagagatgtccttgttcacgctgtggagtcttgcctttcaggtcagcctttctgcctttggccttcatactgccagtgcgcttgggctccaccaggaacacggactatgtagttggcagtttcgagaaagtcgaatcaggtcgcacgttcaacgccaagacaaaggccccatgagcacagggtgcgccgttgcaggcaagtgcaagccattacctccgtgagcgagtcgaattcgtccatgctgtgcactgtcgacgcgcagtagagagtacatgtaccattctgaacggtgccgcaagatcgttgattttttgactttgaggtcaacagtcactttggccttggcaataccgttggtgatcgttgaggcgaaaagtgggccattcgagcgagtccttcttcactcgtccttggcctccggctcaatatgcattagcagccctttagcaaagtctctcgtccgtgcacctgattaggttcagcacctcctctggtccgaatcccctccttccttcgccgtattcgcctctcttccttcccatcgacaaccagttcactgtggtagcctttgacacagcactggcagggacatagctggaaatatcaagcgtggtaaagtgcacctccatatggtccaagtacgagtggagagcattaggcacacggaccatctattttaaaattgccatcgtagcccaggcaggcatacatgtacatgtatttcgcttcatcgatggggctcactggactagcgagtatgcaacaacgcgttcctagcagccttgaagcaggttgagagtgccaaagtcctccctactcgcgtccgggtctttgcaaaaagcctttggaccttttattctgagcctgaaggctccgtgaggatccaacatgcccagcaagaagcgacgatacgaactaggtggcgagttggaggaactcacttcttcaagaagggcgcatttatttctttgcctgagttctactttctgtactctgcatggtcgtgcatttttctgatgttgactgatgttgttgcataggctccaagcgtccgccaacacgacagttagaagaaaacgaggggtctcacagaagcggacactcgacaagcatgaaaaaaatcgcaacagcgaacaagcagcaacactgcttcaccaagcccccaccgtccgtcagtgcagtcagttatcagccgggctacttgacgatattgtccttgccactttgcaaggaaactcggatcctgctcagttggagatattccgggggaaagatagatgcaacggcagagaattcttatacgtcactagtgagcgaggaaaagggagtggagagcgaggactgcggacctttgcccgcctcagaaggagtaccatgaaccttctttcgcggatagagtgtgcgtggggatctctactgtaggacaggagtgggacgcagatggagtaatccatggcagagcgaggctgcgcgaggggatgcctagggatggcgggagcggaaggagacgggggcgacgaggacgcgcgccaggggcggggactggtctgtctgtgttcgtttagtcgtttagtctgcctgatggatcttatcagtgatgcagtatttattttttcgcctcgttttatttcagtctccactggcccgcctgtttttcgctctcttttttttctctctctctcactccccatccccatccacacacccgctcccccaaccatgctccgcctggcctcatcaaagacccccctcgcccaggtactgctgccgcgccctcgtcgtcgcacacctgcatcgctcgctgctgcatggctgctgctgctgctgctgctgctcgccttgcgctgatcacagctgtgtctccgatccacgctcgactcatccgccttgcttctcctccactggcctcgtctgtgccgcatcctgaaatcccctgttagattgcagcgcgccatgcgcccgctctccgcgcccctgccttcacctccatgcccagactctactccaccgccactggtaagcgacctgcccacgcctcttcctcctgtccctcgccagcaccaggggatccgccagaggaacggcctgtggattctgttggggtttggcgaatcgtagacacccgtgagaatattcagcgcacccgtactaaacctacttttttttccatcctgcccatctgcccttgccctcgtcaaccgcaatcgaatggactcgtagaggagctggatctggttgtcatcggaggtggccccggtggctacgttgctgccatcaaggctgctcagctcggtctcaaggtacacaggatggctcgattgttttagatcgcgcgtggcactgggtgctctcccttgtgtgcctcccgttcctgttctgcgcagagcggacccactggagtgggacagcgacgataacaccgccatggcagggacgggcgtacagcaaaagaaacaggactaaccgcccccacgatctacccactgcgttttttgcctgctcatatagactgcctgcgttgagaagcgtggcgctctcggaggcacctgcttgaacgttggatgcattccctccaaggccatgttgaacaactctcacatctaccaccagacccagcacgacctcaaatcccgcggtatcgatggcaagtacacccggaagcgttgctgcgatcaatcccttcagcaacagcgggtgaccaattttgaccagctgcagtgctccgcagtggttgctggaatagctgactaatcgtactcgcttatgatcctgttcaatagtcggaagcgtcgagttgaaccttcccgtcatgttgaaggccaaggccaacgctgtctccggactgaccaagggtatcgagggtctcttcaagaagaacaaggttgcctaccacaagggagccggaaagtttttgaacgccaacgagatcgaggtcactggccttgacggcaatgtctctaccttgaaggccaaaaacattttgattgctaccggatccgtcccctccggcttcccaggaatcgagattgacgagaagcagattgtcacctcgactggtgccttggatcttcagcaggtccccaagaagatggtggtcattggtgctggtgtcattggactcgagttgggatcggtctggcagcgtctcggcgctgaggtcactgttgttgagtacctcggtgccatcggtgctggcatggacggcgatatggcgtacgttcgttttttgagaacttcttgatttgcacacgatgcggctactacacaaccgcttacaaatgttttgtgatgctttctgaccgatcatagtaaggctttccaccgcaccctctccaagcagggcttcaagttcaagttgagcaccaaggtcatcggtactgagaagcttgctgatggtcgcgttggtgtcaaggtcgaggctgccaagggtggcaaccccgagactgtaagcgagctttgctgtgttgtatctttagatatgtccttcgaggtccgttacagcgacgctaatcaccctcgcttttgttttcaaactcttgtagttggaggccgatgtcgttttggtctcgatcggtcgcaagccctacaccgagggtcttggcctcgagaacgttggaatccaggttgacgagcgcggccgcattcccatcgactctgagttccgcacctcggtccctaacattcgctgcattggagatgttacctacggcgccatgttggcccacaaggccgaggaggagggtatcgccgctgtcgagttcattaccgagcgtcacggacatgtcaactatgacgttatcccctcggtcatttacacccaccccgaggttgcttggtgcggcaagtctgaggaggaggtcaagaagtctggcgttgcctacaacatcggaaccttccccttcgccgccaactctcgcgcacgcaccaacgccgatgccgatggtatggtcaagatgatctctgacaaggagaccgaccgcatccttggaatccacatcatgggacccaacgccggagagatgatcgctgagggtgtccttgccatggagtacaatgcatccaggtatgtattggtgttcttttagtattggtatgctacatgtccttttgtgaacatttcattgaccatgtccccaactgttgttcatgtatcttagcgaggacattgctcgcacctgccacgcccaccccaccttgtccgaggctttcaaggaggctgccatggccacctacaacaagcccatccacttttaaaaaatctttcctgcatccaactacaccagctcaatacttttttctcccacccataaacgccaaatggctcaacattgttgaatagtatcccatcgtcgcattcactggttgcgaggtctctttttttttttttttttttttagaaaaaaacaaatgaactgttgtcgcctcagtatgaatagagtggtcgcacagacccgagttagtggtaccatagctggcgatcggcgactgaagaacgcgtgagcgaggaggcggagcaaccggcgggagagggactggaatatggaacatgcgcataacatcatcctgttctttatcccgaagcattccagctcatgcggatgcgcaggatttagactactttatacgctgctagcaggtctcaaaacgggctcgttgcaattgcgactgggcagggtcttacatctgtaggcttgttctctgcaaggattttccgtttcccgcttcttttgttttttttgatttcattttcttttcgcgtttctctccaccgctactactcttacgcgcctgcccccgtcccctcgacttcatcactctctggttagcccacagaccagcccttcctgcccgcgtcgtcaggtaggctcctgctttaaatcatggtgatgtcgctgtgcaattttttttttatttgacgccgtggagatgtcataaggagaatcagcggctggtagtggaggagtttggcattactgcccaatcagcgcagctgtccctttaacggaaccttagcccatgaacccttgttttgagtatgcgacgacggacagcgcttcacgcaactgttgtgtgctctgtgtgcgcgctataagatcgtgcgctgggcgagcgacagggggagcgggtagggagagtcgcagattgttgagcggaaacaggcgtcaggcggcgcaagagctgcaatgatgtcaatgcgacgccagcgtgtccagcgcgcttgtggatagataataccaacgcctgggtataaagcaagctggcgcttgacttgccaacttgcttacttcttccatccctcttcctccactcgcgacatcaatctcttgcccagcttgttactctgcctcacccaccctcttcttttcaacatacgttttgcaaaagaaaaccttctcgtgcctctcagcccgctcttcctatattctcattctgacctaggagctcttcccttaatccgtaaccactttcaaaacagcacggccaacattaacaaaccatgtccaagaacgtttccgaggcccagacctcgtaccacaatgtccccatatccgacagcggtgccaagatcccccagcacatcaaggaggtcgaccgcaaccaaaagttcaaattctttgaatgtcttcaggccctaatgaagggtcgtctgcccaccaacgagcagattgatcactttctcgccatggcccagaactcgcccgcgctcgaggcccgtgctcacatgctctctgccgacggtcgctcgctctatcaagacttccaggagctgatgcggaccacccggggcatcgtctttgagaagaacgagcaagagctcttccagaactttatctaccactgcaccctggcctcggacactgccccccagaatgtccaagcgcccaaccttgacgtcggggtctctgccaactctgccagaaaggagggaaaggaaacccttgacagccttgtcgcggtcgccaaactcgtgacgaccaactctgacttccgctcgatcctcaacgagctcttccagttggcgagggaggtcttgacggagggtgcagacaagttgggtcagagcgcccaaatggctggtgatcgtttgaccgccaagtccaatgaaatctcgcagcaggcggccgctgccactcagtcgggcggagccaggctccaggaaggaatcttcagggccaacgaaacggtccaggacgttgttggaaacgcccaagtcgaccctgttacgacgtaccatggcactcgagacgacattgttgagcaatcccaggctggcatggattcggccaaacgccagaccgccaacctgaaggccaacatggcaaagcagaccgaagacctgaaaggaaaggcccatgctcaagccatcgaggcgcagcacaacctgaccaattacgccaacaccaagatgcccccagagcgccgcaatgcactgatcgaaagactgaagtccattgttggacagattcaggccaatcctcagtatcaggcggcaattgattcgatcatgggcttggccgggacctggcgccagcgagctcaggggcccgcaggcaacgtctccgcagaggccagcaaggtcatccgaggtaagattaccatcatcatacccctcattgacatggtcgtcatgattaatgtcgcgcatgctgttctaataccaatctgtacttttatacgcccttgttactacattatagatcccaatgttgaggctgctattattgagttcaaagtcatcttgcagcgctgggcgcagggctacagcctcgatcccatgattgccatgatccagaacatgtggtacaagacgaagacagaccccgagctgagccgctatgtcgacaatgtttctggcttcatgaataaggctgttcgcgagcccaactatgtgacctcgcagtccatcaactcggacgcgacagcattgatcgataacggacagatgcttctgaaccagaggtacaagcccgacaccgatgctctcttccaggagggccaaatctttctcgacaagctgaacaacgatccaaagtccaaggaggtcgctgccaactttcaaaagtttgccaaccacctcttttatgacaagtaagtcaacacccatgagatccagtgtgcatcgtcaattgtattcggcttttgttccagcgtctaatcagagcacgttcttcccattgcggtcataggcatggcaagctcaccttcaagccccatctctttgatgacttccgctacgttctcctgcctgcgatgatggaatccttccagttcattccaatcccacgcatcgaatactcagacctcaaggtggatctgatgtttgacaatatgattctcacgagcacggaccttctgccgcgtctgttcgaagtcaacatgaacaacaccctgcgcatggtaccccgtggaaacgccaaccgcagtcttgatgccaataagcacgaatttaacatgaccatccagggtgtcgaggccaacgttcgcgatgtggactactacgtcaggaccaaggagggtttccgcttcaaggaccggggtcttgcagacattctgatcagcaagaagggaatggacattttcgtcaaaggtcgcaagtctgccgaggacagtgaggtgccctcactgatcactgttgacgacgtcaaggtcaagatccactcgttgtccattaagatgcgcaggtcccagcactcgtaaggacaactttttaccacatcaagaatatggattaggctctaacgaaaaggttttttttagattgactgacctgacccgctgttctcgctctgctgtattttcatgccttcaacagccttctctatgcgtttgctcagccatttatcaggacggttgtcaagaatgccattgcgcatgctctggaggcccagatccgtgaggccttgacctcaggcgacaaggccgttgctacctcgattcgcgatacgcgtatcaagaccggcaagaacacgtttggcgcccttgttgattcggcgacctcgttcgtgaccagcaaggtcaagcccgatgagaagaccaaggcccttaacgaacgcaagaggaaccaaggtcattacaaccgcacatcccgtgttatctttgatcaagatggtctgtgcgtgctggaccctgtcaagcatatggagctcaagattggccagcccctgcatgaggatccgaacgtgatggcgtcgatgcccgttgctgcaccatgggtgagcccggcatttgatatgaaggacatgaccctgcagggacaggagcatcttccaggcatgcgccgcaccccaggcactctagccatgtaaagaaagaatgaaaaaactaggaaaataggaaaggcaccaaagtctatagcaggtagttaacaaaatcactattctaataatcgaggcaacaaaacattcaaaccatgcatcgcccaggagggggcccgcgacttggccaagagcgatctgtcaacaaaaatgtagccgggcactctcaatgtctttgggctacatggcgtcccattcagcgtctcattaaacgaagacatccagaaggcacacaaccagctacagcacgtgggcattgttccaatcagcagcgaagagccaaacccgagccttcaagtgcaagtaagtcggtggatccttcagttgatcgacgaagatggcgtgaggcttttggctgatcaagagaccacgcgctgtgtgctgcgctcaaactttctggtctggattgattgccgacacccttatcctagcctcctcggcacgtcattttcaaatgtaccgtgcgttcggccaacccagccgactgttacccctgcccaacctcatatagcacaatcgcccgggatataatcaccaacaaagcggatccccttgaattgatcataaattgttaatcaagcatagcatacagcctagaccgtctggagcgactccaactctggcacgacatactccaatcgatgctccacatcatctggatcgcagagtggggacaaagtcgagatggtgtgactgtaactgcttactcctaccgtaagacgacaacggaggactgagccctgacccagaccaacaggctgatggcactcgaactcggaatctacacaacatcagcactctggcagatgaggaggacaagcgcgcatcccaaccacgtacttgcacaaccaacttcaatagaatcatccgaaaggagcatgtcgccacaaagaacgacagttgaaactggaagaggtacagaggacccaacgagagatggcaccagctatttctgatgcgtttatagtcgcgcagatgacagcgatcgttgtacgtgcaacacggatatgaaaaacattgttaggaaagtctgattaccactttgctgagccattcacctactcaagtcgtatcaatcggtgcctacaggaacgacgatgagaagacccctaagaaccagtttcagttgtcagccctggtgccagagtcgttccaaggcgaaggattccatagccccctagcgtctcctgcaaggaggtcgtgacatacatttatcgagacaccatggtaagcaatatcttggcgaatatccttcaaagtctccgaaatggctaactacagccaacggacagataggcacattgctttgaacccgctccggcagccacctcctaacgaccccagcagtggttcctgcagtcaaaaacgcaagtcgggctaagatctggacaccccttacgacttcgaaaacccaaacattgtgcgacgtaacgcaatggaccgcacggtcaatagtgattcagtttggacccttactcctcacacaggcctcgtgttacccgcatcaacaagcataataagcaagacagagagagtgagatgatgaatggtgaaatacattaaacatacaattaggagccttcgctctagatttctcgagaagatcatcgtaggtcgtccgtgaggctttcaaaaaacgatgagtggcgtcaagttcgatcggtctacagaaccatacctcccgcatccatgccacaaatctctagcgacttttctaaatccgcttccagctgaaccttgatctggtggatcaatccttgtggcaaagacggtcctaatggacaaacaaagtcgagcgtcatggtatgtgcaaaggggtatcgtaccgtgtgctggcatgttgtctatcatcaccatgtcagaatcgatcatgtcagactcttgttgactcttacaaatgcggcgttcgtgagctgaaaaacacaacaatgcatcagcttacccagtggactccgtgcatatcggatgcaagaactgtcatctgtccctcgaggactgttagagactttgacgacacaaccgtcaagcgctgaagagccataggctttacaaaccggaggccgaacgaatccccgaccttgggcaccttgaagctgttccagcacgtcaagggatcattatcaactgcatgaacataggcaaacgttctccagaactctgttgtcgggtaatccagctccatgaatttcgcgttttgttcgtcaatcgtttgcagatcccccttaaagaccacttctttcggatccggaaaagggtcaagactagtcatgaacagacacttgtcgttgtggcatggcgatctgtgaaattaccagttaggaaatcttcctttacatgtgaacgagtcagtggacgtgcatcaagtcgtgcatcttttaccttgtgtgccgatcactgacatagggctcttcctcctcccgggcaaacggatctttgtgagtctcctcaaggttcgtcagcagtgctgtgtacagtcggtccgcagcatccaactaggtaaagataacatcaaccgttcagtatctctcctctgtcatctggacctgacccaagaatcgcaaattccaaatggccttaccatgtttctaaaaacaatgctccagtggtcattcacgacttcggtgctccatccattcttctggtccaacggcgttaggtaattgacgagctgatacgggtactggttggtccagatggaaaaatacatgtctatgaccttaaagcgatccttggccaacgtagtgtttcctcgttgctccagcagtcgtcgcgcctttgccctaggcaaataagatcccgtgcccatccacgaaaatcctgcgtgcatattaaagtctggacacgaatatgcaagaagatagaaaggcgaatacgtcagtagagcgacaatggacctggaggtcaagggaatgcaccccctttcttttccaattggacaaagatatataaaaaaaagaaggggacgggctggattggatccttccttggctggcatccacggtcgtatatcgcagccttttttttttttttttgctgcaagtccctcaggtgtgcacttgatttgggagaccgtgcgtgctcctgtccggggacatactgtgccatcaagcaaaccacattcactaacgaggaggagagagaacagccccggcgatggataaagtaaaagagcagaaacgcttaccttcgtttgtaaaggtccatcggcggtgctccatctggataagcggcagggtgtttgtatggatgaggttggggctggtcaggaagtttgtgtatagggcatccatgtgggtgttgagccagtcgtcgtcctggaagtagcagtgctcgtactttgccagcgagcaggacatgtactttgcaaagtcatggaggttctcggcggcattgtacacctgcagctctggcagattcttgtccacggttgatgcgccgtggcccaggctgtccgccagctccagctcaaagtcccgctgcgatagcttgagctccttgttgttgttccagacgatgacctgcttgatgtaagggtacctggtcaagtacttgacaatcagcttcagaccctcgattcgcttccagcccagaagaatcgccgtcgccggcagaaggtgctcattctctggctgctgcagcccatggtctgtaaagtcctcaaaggcataggacgacttgcgagtatccagaatctgctggacaattagctgccgctctagctcgtcgctcgtggtgtccttgctggtgctgggtgtgtcgggatcgaggatggtgcccttgtcctgcggcgcaaagatccggctgacggcgagcaacgatgcgatacaaaagccgacgaggacaaagaacttgatggggctgagtcgcctggcggcagtgctgctgctgctgctgctgttgagcgtggaggagagcgacggggacggagcgttggagagggggcctggccgacggggagcgggcgagctgctgaagtgaaacgggaggccgttgctgttgctgttcccgttcctgttcatgatggcaccgtctgcctcgatgtgtgtgtgtctgttgctgggatgcgctgctggctcgaggcaacagggatggtgcagcgtgcgggaggctgagagaagcgcaagggggatgtgaagaggtgttggagcaggtcgatgtcaatgggagtgtcagaggtgagtgtgaagagtgagtgagagtgctagggtgtgagggtgagtgtgagtgcaacagaggtgtgtgtgaaaagggtgcaaggacaaaaacatcaaaaaagtcaaaattcggcttttttttttttttttttttttttttttttggttggatcacattgtcaccgggcactgtggcggtatccttccacaacggcgcactctttcatgaccaaagcgcgtcgcgtcgcagactcaaaccctacatggaggtgttcgtgcgcgccggcgggcgtccggcctcgttggtcttggtcgctgttagcatgaatgactccaatagtcgggcgcagatctcgccgccattatgaggtatgcgtctctcaaaccacggtgtcgcctctgcctccgaccgcatcgtttctggttcctcgactagggtcgtgccctctacttgtctagactggtactcctcttctgcagcggcaggtttgccgttctcgaaccagacatggccttgtttcggagcccttccttcggcactggttcttgttctcgacctcattgtagccgatgtcaacgatgagatggaagtcgagcgacgcgaacggccaggcgataacaaaggggggtcgtcctcatagtccttaggcgatgatatcggtccacctcgagccatctctgccatgttaacggactcagccagtgatctggccctcgaaggccggcgctggggcgcgtatctcattccagtactccgggaccgatttaggctattagcactactgctgtagatgtcctcgccttgacttttgcacccggctgtcacaggtttctctggatttgggtccttctcgtgactgatctccaatgcgtatagccgtcggccttccctctcctcttctgctaggcggtccgcttcaagaatcgatctctgccatagtccagtctcaaactcctcagctgtcatctctacaggcaatccgtggtttatcatgagcttgatcaacccgtgctcttcgatgaactgcggtcgcgacacataaatcaacgctgtatcatgggcgatgcactctgagcaagttccgtaaccctacgttcatggaacaggacgagaatttcagtaaactccgtgcgtcgacataagacctttttcttctttttttcaaaaacactcaccaactttccgatgacaatatcagctgcatgggtcaaatctggcacgtacacaccatggggacttctgtagaaaccatctggcagctcatgcgatacaggcagcccacaaataaccccaatccagccctgcggcagtggattgccccacccttgcttaagacgttgtcctccaaatgagactagaaccatcttcttggtgcggattgtctcctcatccacccctagcgacctcaagacgtcctcgcggctgttgatcgcctttcgcaccacgagcggcacatcaatggctcgcctccgtgttcgccgacgtggagtacctctcgacgaaatcacagcatccgtggtatcaacagacagcttcaggccatggcgccgttgcccccgtactgcgacggatgacgaggactgtacagtttccaagccgctcctggcatggtccgtcaatcgttcggatgacaggtctgaattctgtccctgagcttctacttgttgccccaactcttcttgcacactgcgtgctagcctggcgagatcttcgaagtcctcttcgacctcctctccgatacaccagtcagccatgcccgatacaagggggctccagatatctacatgctcaccgctactcgggcgcgtggactctagtgtcatgatttcgtcctcgaacgagggtatgtctatggacccaggtagacgcagtagcaatgacgctttcttgtaatcttccaatgccgcatctgcacatgcaatgacatccttgtccagggggtcgccttcgcgtagaaatcgatagacctcgtcaaacgtgaagtttgtaatcaagcacgccgggatgccgtatgcacttgcagcggcactaggcatcaagcaacgaggtaggaaatgaaggagaaattgtactattagcagccattctaaacttacctgcagcattttatgatagatacctttgcaagccatcgccggaatgcgttgatataccatgggaggaagggagcatctgcgagaacacagttggcgccgacctgtcctagccacgccacttcatgctggatcatctcctgccgctttgccaaaaatgcctttacgccttcaatggtgctttgacggtccaccgagtatgcctagtacagtccagaagggacgaactagatgagatttggttcccgaggtatgacgttatgatcaaccgctgagagtaagagctcacaaggcgttgctgcctggacctcttaccaagggctgcactacgcctgcatccaccttggcgtttcggtagatggcacccagagcgatcacatcctggaagatgaactggggtgcgtccgaaacaatgtggattgtatggcgggaggtagtgctttttgcagtcttggacggactcgtcgtcgtccctgctgtctctgctgtccctgctgtctctgctgtccctgctgctaacgctgttcctgctgtgctctgtgtgccagttgtaggcgctgcaacagttccttgagcttcttctgtcgatgggggcgaggctcttgactttagaagctccgtaatgatctgattcacacgcgtggcatggccaaaccctagtgcattccacggcaacaatggggcaacaatgagcacacagtcttggcctttaaatgagcttccttcatcccgcgctgggcagcatgtggtcctaccgtgccccgagacgtaatagcagaatgtgtatcctttggcggtcattgctgggcgacaaagaatctggcgtgtgcatgagaagacaggtaacctgtagtatctccaagtcttggtgctattctattacaaaccttaacggagcaccgacgtgcctcgtgccttttcgtcttccacgccacacacacacactgcacacagacacaacgttcacctgccacacgcgtccagaggcgcaaagggtgttggggaggcactctggcagcggtagtgatttcgttggtcgatcctggagggagcgactagcttgactgtgaaatgccgcgggtcatcagatatagccgtgtcgcgttagaccactcagtagcatggtgcaggtggatagcgtgagcaatgcaagcgcgtgaattatccataaatccaacgcgatctcgctcaaagttaggcgttttggaatctgaagtacgtttatgcaatttgactacaagatgcaacaacgcaaaaatctgggtaaacgatcatgacaaggttctgattctaaacaaagtcagcagcgaccctgaaccaggtggtgtcgggttgacggaggtatagagcttcctgatccagatgaacctgcgcagggaagtactgggtgtcatattccaatgggaccgttgcatcttttgagatatagacctcgcccatcgtgaaagtgcctgaggccttgacaggaaactgagtgggtgcgtccgccgactggaaaccaatcgctttcaagttgtcaacaatgtctttgttatttttcacaaagcctcccgggaaggagaaatatgacaacggggtgttgtatattcctccgatagcatatgttttgacgccgtgaattgcggcgaagcgggtggcgatcaatgagcctgaggaaccactgagggatgaaataagacgcatcgtgttagacaactttcatgtctttttttttcgtttttttcttttgtgaacaccaaaaaaaaaaaaagatgggcttaccagtttccgttcgtaacgatcgccatatcagctgccttccatggcaatgccctcttcagcgagtccggaactaagttgtaacttaggtgacacttttgcgagtacttttcagtgatgccgccgcgtgtgtaattgacgccggccaggaacatggactggtcagtgtacggcgcttgagtgctcaagtcgatataatcacgcgcgtcaaagcttgatgcgacattgctgctaccagcaacagtcgccactttttccacaaagggcgtcgagcgtatatccagaacaaaatatggctcctcggctgggaaaaacagctggttaatgaagtacgcaaagtccacggatccgccaccattgttggtcatgtcgaatatcaacttggtgcaaccttggtcagcgagaccgaacactccggctgcaaacgcctcatattcgctttgctcgggatttttttgtgtcgtcaaatcaacttcggacgcgatgacggcgacgcaaaccttgtgcgggatgctggcggaggggaggtcgttgagcatgtaaaacgcactcgtatgtgtcgtagcctgtagcgttgcgtttttgttggggtccgctgcatagttatggtaattatagcgactctcgggaacagtgaccgtaccgcgctctttgaacaaggtgacggcgggaggaagggtgacttgaccctctcctgattcatcatccgcggacgtgaatgaagccaagcactgggtgctccagtacgatggggcgtcggtgaactgaccaaacaagaatttttctgagggcgtgaccgtccaaggcactgagaagctttgggggtcctcggaaccacactggatagtgtagtccatgctcgccttcgcaggaacctcccagcgcatattaaagccgccagggcgcagaccccaactttgactccaggactcagtgatgagcgcatcattcaagcgaacacctggatcctttgaaacaatggaggatcgatctgcaaagtcctggatggctttcagcgctgggaggccatcgatggttgtcacaacacagtcctcgatactctgctggggcacattggggttgtcgtaatttgccgcaaagatcttgactgactgtacgccgttctccacaggtgcatagagatatatgggctgcgcgaaccacgcgatctgatagcactcagctatcatgcagaagcgggtattaataagagttttgcatcacccagtagttgattcgcctgagaaggacgtaggtgacttacaaagataggcaagatgggcatcatggaccgagaagagcaaatatgtaagagccatgctaaaatcatagtcgctggtccactgagtggatcggatcttttgaagacccgcctttagatccactgctggcgtcttgaagggttcatcagctgccgccttgaaagcggcagccgacgtcgcattaaaaccttcagcagacgctccggcaagagcaccgccgtatccaaccatggccatgtctaagaaggcgtaaatgttgccaagcagactatccagtgtagagaggatgctatttgccactgttgggtcaaactgcattgaacggtagcagtcgaggactgtctgatactggagggtggaggttttgtcgacgccttgagcggccaggtcggcacacgccgtgctgaccggagtaggagttgccgttgtggaggttgaagaaatcaccgtagtggtcgatgggagcgttgttactggcgtagtcccttgggtggttgtggtggtgtcagcgatcgtggtgatcgtggtcgactcgctggttgtggtggtgtcagcgatcgtggtgatcttggtcgactcgctggttgtggtggtgtcagcgatcgtggtgatcgtggccgactcgctggttgtggtggtgtcagcgatcgtggtgatcgtggccgactcgctggttgtggtggtgtcagcgatcgtggcgatcgtgatcgactcgctggtcgtcgtagtttcagttgtcgttgtcgattctgtggtcgtgattatttcggacgtggttgcgactgtggtcaaagctgtgctagtagaggtcgctggctggtcggtagtagcgagcgttgtcattaagctaggcgtcgattctgacatggtgggactggaggttgcgcctcgtgcgggcgattcagattcagccatggtcagggtagctgaaacggacactcgtggactagttgtagaactggacaaaaccacgccagcgtctgtggtggcacttggcttctcagtgagtgttggccgtggaactatgaaagcaggaagcgtagaggtgacaatcatcactgaggttgcactagagtgaggtggctcaggagagcttgtaaagaccggtgcattcgtgctgaatctcaatggggtcttcgtttcgactgcaggagatttgggatgcgcggaaggtattgtagcaggcgcctcgatatcgcgtgatgaggactcgatcttggttgtcgtgggacgcgtagagtcaacagtcgtgcagcgctcaatctctgtgggctgtggttgatcactgcattcattattgtgtttgtgggtgtgttttttatgatgatgcccgtgcttcttgtgccaatgcccatgcttcttgtggcgatgaccgtgtttcttgtgcctcttgtgcgcatggtgtgagtgtccgtgcccctggcagtaatttgaccagtcggtgtttatgctgcgcttttgtgtcgaggactcaatgtccagcgaatctgtggcaagagattgttgtatttcatcgtcgcagatgtgggagggtgcagcgttcacgcacacaatagcggtggtaagcgccagcgagaggattagattgaccttcatgatctttgaggtctctggtccgaatccgtttgccagcatataaatactggtgattctctggacgccagtcataattcatcctgcaatgatcatccttctattgaccctcagctacaccgtttaggtacaacataaaggggctatcctcattccagtacgcctgctcttctaatcgacgtgttttccacatccccattcttccggagatggatgatgatccctgcatattcctcggccaaatttcatcgatataccgccatagagagatcatcatctcactccccgactgcgttcgtcccctgagcgatggtctgcattccgataccatattttggactctgcctggacctgccataaattatttgatcgtcgcgcgtatgaagctgaaaagcacggtctcgcttcaaatactaacaacggctagcgcctctcatcaagcttgatccagtttgacccagagaccttgcgatagctcgaaggagggatgagtgacattcaggggtcgagttgcgtccttcgttgccaaaaattctcgttcaggtcacaatatacccgcagagccaggctaaaggacagactttgaggtaattactctgatatatggagtcaagatctacgctggcttgcgagttttctattcgtaggcaaagcgaggcgccaaatacgctctcattgcacctgtgaagcatttgattccaaaaaaagggagaaaagtgaaatggtgcaatgtcaaaacacccgtcaatgaaaaccacagctatttttaaacgtccatggaagtgcataccctgccgctgttgacttcaaaactgcaatccattcgtgcttctgttccaccaaaaccccgatcgcctcttcatgctcaatgtggaaaactaaaacgtatgatactgtatccatagccagcggattgatgtgaacaagacaaggatatggaatgcatcaaaatgcccgctagggaaccggacttacaggcaccttgctcatcagatcactggcgtgcagataaagccagtgcaccacggtggtcctattcgctgcttgcatgtactaatgcttgttgtccaatgccttggcttaaccctccctaacccgttttgagaggggtagaccttcgcggaacctaatgctaagggtacgacaagttctctgtgccattacgttcacatgatgatgaagtaagaagagcagagtacatggtaccttgcgagttgcgatggcagtttcgtgcggtgaaacggtggtacttctgccaggtgtgcaacgataaatgtggtgcacgcgtctctaaagatcgcctggttcatagcacaagatttatgcgccacatttttcgtcgtccatgctgtcaaacctgatacgcaggtgccccttattcaagacagaagccaaaaaagattcgtggtcggtcaaagaacaaagaaatgaggttcagtaaccgtgctgctccgtcgcaagaatgaagatggaaaaagacgagaggttctacgactattaataaaagagtgatgcgcggtcgagggttcgccggagaggataactcctcctgctatttccatgcgaaatttttgttcgttcgtcttttttctttccttgattcatttctttgctttgtttttacccagcattctgagtatccaggccttcaccaacgctaaatacatctcccaacaccagctgcatgaaatttgttcctcccaagcactcccaagcacccactattacactagagaacatacgcgacagcagcatatttttcatcactatccccttccatagatatagcggcgaactcgacagtgcaccacaccaaccatccgactaaaaacataaaagactctcaaatggaggatataatcgacttgatagcggaggagcgagacgaaattttcgttagcaacccagtcttccgaactgccttgaggactactggaaactcacagacagtgtctgcgtttgactccgatatcaattttgtgttcgatgccgccgcctttaccaaattgctctcggagccaatatctgacgacagcagcagctttacagaacacctgcgcgatggtgaatgttactcatcttccagtcctggagtcaccggatcgatcctagaggtaccaaacacctttgacaaccctttcaaatctcgaccagctctgctacaacatggacttcgaatgggtgcacgtcggtctacatcagctacactgcaagcgcaagaggacctcgaccaggacgttgaacaacgacgtcgcgaatctagtgcggcgtcctccgtagtccaacatttttcagacctgactattgctcatggaccaactttggctagcctcgaccagcctgccagttacgaaaacacacatcatcacccccaacccgctcctgcgtcagcatcattgtcgtcgttgtcgtcgttgtcgtcggtctatttccctccaagtgcctcagctttacaccagaaacgtcgcaaagccaagaggcatgaaattagagctcctcgacccaagaactgcttcatgctctataggtccaaagtcttgcccatgatcatggtagagttggggtcaatcaataacaagatcatctccaagatcgcggcagagcgttggcgagcagagtcagagcctgtcaagacctggtaccgccagatggccaagcagggcaaggaagagcacgctagaaaccatccaggatacaagtatgcaccaagcaagaagcctttgagcatggcaagtgcttcaatgccaagccggaccgatcctgagtatcgagacgtggttagagatgaagacgacgacgacgaggacatggaagaggaggatgagacggatgggatggacggcagtcacgtttcacacgatcaagatgcctacctgccagacgctagacggcggtccccaagacaaggcggtgtcttggggcagtcagctccgtacgacgtatcccgatgtggcagcaaaggagtcaaagttggtgttaatgtcaatagccgacataggaggccacgagatgtgtatgctcgatccctcagtcgaaccgacaacgggcttttaagtgcacgggagtacgccatggaccactcgagcagcctctgcgccagcgatttctatgcggcgtttccgatgtccacgacgggatacagttcgcatggaccatctcttccgttgatgggctcttcgctcattgagcagccattatacttgcaggtccagcaacccaagtatcagcaggcgcctacgccgcttttacagcatcaagatttaccgcagcgatctgcagtccagaccagcatccctcacgggccctccttctatagccttgatgctgacatgaactccagttcttccactctggttgatcctgtgaacaactggatgacccatcgataccaggaccccggctcattgttagagtacttgcatgtagctgacgcgaacaaagatgccagccgttgcatcattagcgacgcgctacaaaagtctctgggccaacaacaggccgctatgaaaggaccgatggagatgacgcatcttttgctggataaggatctgccgccattgccatttgagatttctgcgcaagactcttgcctcgacacgtcgtcctttaatgacccccagacggttttgtcgcacttgtatgcagcatacaacaatcttggtctcgagcagggatttcctctacagctccttgcatcgaaagagtgcgagccgcaaatgatttcgatgaatgacgatgattttggatttaatgctcggctttcgggtgctacagcttcggatgaactgctaggtcatcatcatcagcagcagcagcagcaatacctgatcaagcccgcctatcccacgggatttatgtcgtttacagatattggagagggcgcgttctcgacaatggatatgttcacctggcccagtcagtcttgatcgttcttacaccactgcattcatctttttttttttctgcaataaaaagccgctcattccactataggatccttatctcgtacctctggcaggtacgtcaggcacatactgtaggagcgagccaagcacgccgattggctgcaagtggtggcttgcggaaggttcccacggccacggctgcccctcagcgtctgactcactcaaaaaataaacagttttgacaaagtccgaactcgctgtcgtggcctgagcggagaaatcgccaaaggctgttgcttgcacagcgtaggacacacagtgtgtgtgtgttttggttttgttgtgcatgcgtgtgcggtgcatcgtgtgcgcgatgctgatgcttttgcttgcgctctgcttacgctttgctctgcatatcagcactgatgctactggatgtgcacacacacgcgcactgccagtcggtcgagcgtgtccgccttcgctcttgtagcccttggagggttgcgctgtgtcccctcccccccttgactcagacaagaagacgcgctatcgcaagacctacgccctgcctccgcttggctgggtacgcttttttttctcgccttgtccgcttcaccccgtccggcctcgcagtctcttttcctgttttcagcgtataccctccatccacaccatccgtcatctccactctgtctttctctctctcactctctcacgcaccctcgctttcctcctgccacggaccatagcgacagcccttctgcacccgttaatggaccacgcgcagaccaagcgacctctctgagcaaagccttcactctctcccttagcaacacgctcagcagctgtgttcatctcacacctccactcttgcatcgcacaactccactcttgcattgcacacctccagcaccctccttctccctcgctctctctcgctctctctcgctcctctggccagcacaccctcctccccccttctttctgtcatccgcgcactctgtccccttcgcgaccccttgctgcgatcaaaccccccaacacctacagtacgcaacactcgcaggattggcgcttcaccatcggcttcgccttgagatcaagcagctgcagtcccgtgttctcccctacctcctcgttcaaccattctcggtgtatgtgctcgctctacagcatcaacaacacaaagtttgctggccagtcgtccttccaggtcgtgctctgcgccaaaggatccgacagccagcactactccgtgtcatcctcttcttcgtgctctccctctgcgtggtcctcgtcctcgtcctcctcgtgctcagaccgacgtaaaaagatgaaagccggtatcttgctctcctcctccacccctcagcagcagcagcagcagcaacagcaacagcagcagggtggccttgcctcccctggctcgcagtcgcagttgaacgcgttgcactacccgcctctcggccacaacaacaccccatatcatcatcagcagcagaacaggcgaagacacagcagcagcagcagcagaaccgcgcactggcaccagttccaccacgaccatctcgattccctagacgcctctcatccacacgagacggtcgagttatctcatcgtcatccgcctcacagctatcctcagaagcgctcctcgtggtcaaacaaccaacgctttgcgagcagtagcagcagcagcggcaacagcaaccagaaccaacgtgtcctggcaagtcctgcaagcagcagggacgcagggaatcgcatgtctctgccaattctgaatcacaccagcaacactcacagcaggttgcaagtgaaccccaagactgtctcgcacgcgtgctccacaccagcgtcccacccagtctcgccataccctcaacagcctcgccagcaccaccacgttcatacaagagcatcgatggatcgttcgcggacagcggatcctatggtcatctcgttcgctgcagctgcagcggcggctctctcttctgccgcttcggtcggtgctgccgccactccgtcaccgttgcctcgttcagccctgacctcggccttctgctctaaagagtcgtccttagtgtcgtcggatcctgtagctagtggcgctggcgcagactctaccaggtacgaggttgatctctgctgccgttccacacattgcgatatgcgtcaatggccgcatgagtttactaactaacgcgtcttttaaaaatttccttttcctattgcagttcccaaaagactatggaggatgcggatgtggcatcgccacttgggtcaagtgtagaaagcggcagccacgttgtctttgatggagatgtcatggaccttcaccaacaggcgtccgatcccaatgactcggatgcattcatggttgaggctgaaatgaccgagggccatcatacaccatccactgtgaggggcgacaaccgatcggcacagagtagctcggaccttgcgactttagctgctgtatttgcggacgccattccgctggagcgcaaatcgcgcctccgacgaaaaatcgagcgtctccaggccaagaaccaagccctcaagtccagtatgcatcaggcaaaatccgatctggcccgggaacggcagcaacgaaagatggtcgaccagatctaccttcagattagaactgacttgaaccaaaagcttgaggccgaggagatcaaggtgttgaacttgaaggccgacatggagcaaatggccagcgacatgaaggagctcaaagaccggttggccggcaccaagtctcacacctccctggcttcctgcatctccacgtcttccacactgggcaggagtccaccgtcgtcaggttatcgaatcggctatgacagcaatgcgttcgcactctcgagcggattttcaaacattggcggcttgatgctctatcctcaaacacgctgcaatgtagacctgattgacgggcaggatgatgcggaagagtttctattctcgcactcgtactcggctacggccgcccgatccgctcgctcgcgatcgtcgtccacacccgcgatcaccgagaccaagagaagcatgagctgcagcgaggatgacgaagacgatgacaacggcgacatgacgattgaggacaatagcgatgttgacgagggacgggacgacacatccgcactgtcgaagcttacccaacgctgtcgtcgacctactgcgccacctacctcgcgccgagcaagtgttgcctctgccacatccttgccgactctggtcgaggaagaggatgatgacggcgaggagacgaaagattccagcaatgaaactggccgcagcgaggatgagtcagaagtcgacgatgcgcctcgtaccatgatggagatcatcatagaacgggagagatctcggaccccggaggacgacttggaggaccagcctgctgacgcaaatgagtcgttcgagtccatggctcaaatgcttctttctcaggccatccactcgagattcacggtggcgcaagcgtacttgcagctggaggagattgcgcttagatatgacgctcaacctcaacaggcagtcgatgtgattgcaaaggagatcctgcgctggtgggaagctgagcgccttggtcttggtgggccgctcgctggcggttggggtaccgaatttgtcatgatcagccaagagaccggtgagcgtgtgggacctagggctgcggtcgagaagaaggtcgagttatttttcggacctttgctgttgcagtttgtggcgtccctgccagagcaaaggctactgcttgagaaactagccatgtacgccacggcggatgcacgatggctgaaaaatcataatgcggtcctcgtggcattgtacaagcacgatgtactcgaagccgaggctgtcctggaatggtggcagagtctggaggagcctcagggggtttttggccatggcggtaataacctccgcagccttgtaagtattttgatcattacctcctggtacctactttgtgccatgctattagaagtgaaacctccttatcacaaatctctgacatttatttgcttttttttttttaatccactctgtcagaatgccaagtttgctgcgtggctggaagatgaggacgaggattctgagagcgaaggagaggacgaggacgaggacgaggatgaagaggagagtgactctgaagaatctgatatttggtctgaagatgaggacgatggggaggaggacgaggatgaggatacgcatatggatcaagacgacgtggtcgagtcgatgctcgagatggcatttccttcttcacccatctctgatgaagagatcaccgagacatatgatccatcaaccaccgcgtccccacccttgtcgtcgtttgcggagcccaagagacgaatcagcttttgtaccaacaccatgtattataacccagacggaactgcatttgaacaggatgccttgtttaccaacaaggaccgggagagcaagaagtatgtccagtgtccgcctttgcaggcctccgtcgcgattgatgaggatgatgtagatgctgccttgaacgatatcagcgcgggctgtcaagattagccagtagacaatcgtgagcagaccgcatcctatcaacatgtaccacaaatgtattttcaaaaaaaaaagggtaaaagagatttgtaagatgaccaccgataaatctcgcgaactatgcaaccctgataggtgttgtactcaaagatatgtattttatttagtgaagttctttagcaaacacaaaaatgcttcaccacatcgcgccacttccccagggctttgccgccttgcgagatcctcaccgcgcaagggcgccatgcttcggcataagcactcatctgttggattgtgatgctgtcgccgacccccatgaccacctcatcctcccgcatcgtaatcgaatactttcgcgacggtgtgtgtcggtctcgtaccatgaaataaaagatccgtgtctcagacattgcaccctcgatcttttgagccacgcgacttgttgcggcggaggcgtaggccgactccatgaccaaatcttcagttcctatatcgtcaaatattccagtggggttcgttgctgatccccctgatatgggtgctggcgtggtagtggtgacgggccttggctgaggctcgagcgtcaggctgtagggtcggcaaacatcctcgacgtgatgaatcgccgccaggtcattcatcctcttcgaaagcaggactaaagcgccacgcatgaacgtcgcatcgatctccttggcagggtccaggtccaagaacggctggaacgcacaataatcatgagggatacccgccgtgtgacaggatcgcgcctcgtccatgggaagcaataaagagcggccgtattcttgagcaaacgatgtctgattcggtgctgccgagtggaactggcgacggaaggtgccgtcggcgatgaagcgagtcataaaatcggcataactgtcagagtcgccatcgacaggcatatctccataggcaagatggaggaaggtctggtgtaaatcaagatgcgacagtatccggttttgattctgttccagggcttgcacaaaggctggtcgctcagcgaggaactggctagggagggccacaaagagaggcgggattttatgatgtataaatcccggaaaggtgtatgtctcgcgcccgtaatgcaacccgtggtcggccataatcactagtgtgctataaaggatgagatgtaagccattgctggtcgtgaactaccctaaaaaattgcagtagtatcacgagtacgtcatatttacctccttggagaaagcagtggcggttcaccgtcctggcccaggagcagcttctgcacaaacgtcgcgaatcgcttatcgaacgagatgtggtggtgatcgggcgagtgcgagtccatgaacgaataggtcgcaaaccgccgctttcctcgcgtactcgcaagccagccttccagatcctccataatgtgctcatggatggccatatggcccgcacaataaggcgtattccaccgcatgccacccatcagtgcatggtcgtagttgacggtaggaggaagggtgcagctttgtccccaaatatttgagacaacatgcatgtcgtggttctcacaccaggctctttgtgacatctgatattgcgctgggatgcgctgaaagatgtgagagtactcgtacgtgattgcgcccgatgtatagtcgtgaattcctcgctctcctccacattcaccatccgtgtgagcagtggtgaagccctgttcctcaaagatgtcccagagccagtgcttcggtcccctgttgatgttttcgatggactgtccagagtagatgaaggctttgttgggaggcgagttttggccgaggacattgtagtgctcgaaatcaaataccctgtggcccctcagttctccttcagctccagtgattgggttgactgacgaggcattgacggtctttagtgtttccataatggttttcatctcgatggtgaactttgctctcgagatagcgtccacgaggatcataacgacatcatccaacaatggctgcggcgattccttggtccctacgacctttgggggcgactgaggctgaacatcgtccggcatgtcgaattcccgaaagacaacgttggcgttattaatgcctggagggcagagtacaaacacatagggttcctgccccatgggtaacaagtcctcgatgccttgagtcgctgtagtgtggtcccggaactcatctttgaggaatgaggggaagtggtacctgtagttttgttggtcgggacagtccacagcgacaaactgctctccatccttccactggatagaggcgaacctgggcccgttggtgatgttgatgggcaagaacgtgttgatatcccagtcccaaggcggtagcttgaagtccgagagcctaaagtcgtccacactgattcctgcaggtggctttagtactctgttgtcgggctcggtctcgtttgctggcgaagtggtgctgaggctgtcgttgctgttgagatgtaaaagcgagagtagggcaaaggccaacgagacaatcatggctgtgccaaacactgtcgccaagattttgcatggatgcgacacacgagaggtggagagggccgcggcaagaatgggtgacgagggcttgacgggatagcgctttgaactggccagcggtgcatagtcgcccatcgcctcaagatcgtcctcatcctcgtcctcgtcctcgtcctcgttgttgtggttgtaatcgttgattccattgaaatccaccctaaagtctctggcgccgccgtgaactttgatgtccgattcactgtcggtgctctccctgcggtggctgccaaagggaggctgttgaagggggaaagactgtcgctgtgtgtgctcttcctgctcttgcgcctgtgcttgggtgtttgcttgattcaggtagctgtaggcgcctcttgcagctgcagagggatctgtcgtccctgccatgggcttggtcgtgcgcagtgtccactgtgtctatttgatgtgtctgtgctccgggtcgcgtggtgatgcgtggagccctccctgccttgttagaaacgaggtcctggaattcgaaggaagctaggcttcttatggaagacaagtgatggcaataactactggcaatggatcagcgatgagccgttgcaagcatgctgatatgatgacgatgataaagacaaaggtgacgacgaagatgaagacagcgaaggtgattgaagatgcagatgatgacagcacgatgagtgaatcaagcacacacatccgttgtttgcgcgcgcgccgagggcgagaccgtttggtggaacagaccaatcgaagcatcaaaagttaaaaatagcagcgactcaagaaacgttggtgtctccttacgcagcccataaagcacgcatggtcgccgcgcatggtcgctgggccgcttccgtgaaagtctgaaagtctaccacatcagagtgaagctgcacgagtggttcattcacgagtgttctaagaggagcttgatcacgttagatagaagacactgacgaagtcaagagtaagtcagaagtaaaagaaccacaacgtcgccagctttcgtactggttttgcatgtgcgaagttgtcgcggcgctcgcttatgccaaaaaacatgcaagaatggacatcagttttgatcagtggccttgtgagtccttgattatcccctcgtctcgtctttcgcctctccctcgagtcactggtccttctctgtcttgtttctgcacttctctctcgcttcgagttctcggacactcagctttttacctggctttttctggacacaggacaagtgataccgcatgggccaaatcgcgccggtcacccgtccgtcagtaatttcgagctcagaaaagaaagcgacaagtgcgtacgacaggggcatcatgagccagcagttcgagtagagcggtctaaccaaaaagcatctaaaggacagcgccgaacttttctcgcagcaaaccaaggggcaagaggccgtggtaaccgctgggcgcaagcagcacatagcagctgagcaagtacaagcagtggcggcaggggaagtgaaccgtgcgaagcgtgctgtggcagatggaaaagacgccttgtggccctacgtaatgcacgtccgctcagagacgggtgcgggcccgtccggagccggagaagatggagcagcgccgaatgcgacgtcagttgtatcatgtaaaccaagtgattcgggctcccgccaaatccaaaaagccctcagacagtcccgacctcacaagagccacctgggatcgctactgttgcacttctcgaggtttagcaggatggtcggcaggttgccatcgcgggcatggactacgagctgaagatcatgtcggtgaccatacctcagtcactggagcgatgccgcaagcacgtgaaccactgccatgttctgggtaagtcgaccaaaggcagaatacgctgttgcaaggagaaggagcgggacgatttgctttcgaccagcgcagaagtgcgacgtactcgagcccagccactgaagctgcctcgacctttcatgatcaccgccgagtgcatcagcgatgccagtcatacggagcaagcggcgagacgtcgcaagctcgcccttggcctcactttacgcgaaaaggagcaagcatgggttcgagacaagagatgatgcttgaagaaggtgacagaccgcgagcggtcttacattcgtgatttcgggaagcagcagcaacatcagcaacaggacatagcaagggagcgagagcaggaatcggaaggtaccaaatcagcttttgtttgtcgctatttgtgtctatggtctatacatcctggtcctcactttctctacaaacatattttatctagtgtcggttttcgatggttggtgcacagtttgccaggcccaccacataccaagaaggtctggcaagccgtttgcccacgtcacggagtgcccgaggaatggcaaagcgaacaggtcgaacgtgctccgtatcatgtttgtagacagcgccaggacatgcgtaggctcgcgccctcccaggcgcgagcgccaaggaggcggtactttgcgtgaacaacataggaatatgccgtcgtcggtctgacatcggaatattgcacctcccaagcatgtgcctagtgattcaagccagcgcgactggcgaaagcacgacgaaaggaccgccggggcaacatggaagaccatccgccttcacagcgctacagaatgcatcagccctgcctgtacgacatctggatgtggttacaccagcaaaggaagagacgcgcactcagctcttgccatccagatagcaggcatctcgctccagctctccccgcagcggacgacgatggagccattcaactccaggctgatattctcgatttggttcaccaacagccccaggccctcctggattccagtatgctcgccccacccacgagaatgccaggcgagctcccgccagggcgctagtaaaaaattcgtacaaagttacatagtttcacctaaacatctcaacttgacgcggtaggactatgcacggtagcggtgctgataaccaggaatgcgtcaacccacgcggagggtgcctctccacagaccgcaggcgccgtaacaagaaacgctgcgtccgcgactcgccagttcatggatgcatcgtgggcgatcgaataaaaaaaaatgtggcttttctaaaataaattttgtacaagcgatggcctgaaaacacatggaaaacctgaatgagctcctctccgtccctcatcgccctctgcaagcacacggcgcgcacagcaatgtcgccaaaagtagtcaagcttcgcaatgggaaggtgacttcgccaatgccagcggcaagcaggcctgaatatctctttgaaaacggcttgcgcaaggtcaagccttatcatcaaacgtatcttgcacacgtgaagcagcgctggatcggccgcactgtgcccgaagtgtttgcctcagagatgccacgcaggtgcacgagcggcatgattgtaaatacggattagataatcgcaagacattttatacgaaagtggctgcaaaaatcctcacgccatggctcccttgcttaccagctgcacctaccggaaaatctaggtcgacgctatgaagcggggcgatgttcttgtcaatgaagccattgtatctccagcgtacatactaagaggcggcgagagtcttcgctcaatgaactgtcatcgtcatggtgaggcgctgtcactactacttgcctccgtgtgtggtgacctcaaaactgaaactgcatgacttttacgcactgcacattagagccacctgtccccgacacgcctatacgagtcattgagcaaaccaaggactatgtggcctttgataaaccacatgggataaccgtccatcccaacgaactcaacttttacaacaccgcattagagatacttcggcgcgaccatgatatccctagttacatgcatggtacatagacatggtggcacgccaaaactttccctaatccctgtgaaaaagaggcgctgacgttgaaattcctctccttagcaatcaaccgattagacgccgttacttcgggaattgtcatctttgccaacgttgccgactctgcagttcgacggcgctttcaaccctcgagtatttgtccagctcaagagcccgcttcgttggtacaaaaagaatacgtctgccgggttgtaggagagttcccagaaggcccctttgttgtttcggaacctgtcctccagagcgccggaaaagtatcggtcgatcctgcaggcaaactgtcagaaacgcgattcgaaaggatctggtacgatcgggcttcccacagcagcttggtcaggtgctttctggccacggggcgacagcaccagatccgacttcatgttgcgcatctgcagcacccgatcgtgaacgacaaactatataacccagattactgcacagcaataacggcatctctcacaagcattacttcaagtggagagacacggttttacccaaaggatatcccgcaagagcaccagccatacatgccatactacatctccccaggaaccccatgtcacaagtgtaacgaagagcgggaaggactaaacactccgaagccagaggagatgaagatatggcttcgagcgatccggtatcaagggccagattgggaattcaaagttgacatgcccgaatgggctgatccagccgtggtcaagtaatgagcaatataatgaactcaagtcgctcatactttcgtggatatatttcagaaactgctgaacgatgatctatgatacttccttctgtcttcactcgactgaaccctttaaaaaatcgccctcctcaccatcacccaccagtttaccgtaacaaccaatgggcctcttcatgatcacacccatcgatccaccgatgatgcccacggcgccctggccaagacaactctggtcgttaccatcctcatccaactcgagccatgacaatagtccgtctccgatctgcttcggcatcgtgctgtcctggccgatgaaagaagcggctccagcagcggcagtcgctgccgtctcaaatccgtcgaatcctcccgagagtgttgcaggacctgtcgacatcatgacacggtctcccaatcgaccgtcctcctctccctcctctccccaaagcacatgcctcgagtccaaccagaccgtcaaacccacgattctcaagtcccgaatctcctggtctgcaagggcgaccgcatccgcgacagctttcatgacctcttggtacagatggcatgtgcatggatacttgttttgtcgggtactcggctgcgtcgctgcagtgtctaagggtgcgagagtagaggtggattggccaaacgtcgaacgatcatggctgggtgaggatgccgactctgttccaggcaagggcaagaccaagctgctctcgctaccaaactgagtcgctgcagacgaagaggccggtctattggcgttgctcgaatggtacctgcatcgaccaaacagggctccgtccttaccagaggcacccaagaacgacagttctgtttggcttggtaaccacacaaccactcttgtcttggcctcttgcaggaccgggttaagatacaggccctggattcgactgttctctttggctaccacggctgtttcgcggtggatcagcaataccgggagcgagggtgcaccgcgaccaaacatggcccgtgcggacatctctgaggagccagaggcgctcgaacgtacatcattcttgttgcgtggccaagcaagatgcggactgttattgttgctattgccgttggtgggccgagggttaaggagcgctggaagggacgctcgattcttggccttcatcgctgccgacgtgagtgcaccccgtccgcctggagatggcaaggcacgtcttgtgaactggcccgtcacttctgattcctgaactgtctcaagaccattgaaagaaagagctgcaggtccggcaacgcggacacgacgttgctgctgctgttgcgaacccgcaactccgaaatcacctctttcgttggaggctatcatttctggcatctttcgagaagcgaccgagcttgcacgacggagcgccttgacgatctcccgatacttggcttcctttatctcttcctcctcctcagccttggacaggatcgattttgtgactatggctcggcgtccaggatagtcatcaaagaacccttcgacaagatctgaaacaccggaacccggtccaaaactcgaagacgaggagcgatcggcatgtccgcctgtggctgtagtgtaagctctggccagactcggattccgggaatgcaggttctcgcggggcatatgaacacctggcgggaaggagatggaagctagaccagtgccagaggcgcgagactctcccatgagtccatcctcgaatccctccagctcctcgcccgacggaagtttgttttcgggtgcgaagcccatgccaacgatttccttctcatatcggtccaggtcaaaaagcggcatgcttttgggcctcgagcccccagcagacatgcttgaagtaagcgaggacctgacttgaccaatgatggtggtaggcctttgcatcatgcgctttatcctgcggcgtcctccccgaggcaagtcgttgttggcctcatactcgtgtgcgttaccctcatcgtcctcatcgtccccatcatcagatacaaaactttcgttagccccgtgctctaatggactcaaacgcgagagatcgagcccagcgttgtcgggcgatggcgcaccgttcgtactcatgaacatgttggaagctgtttgagtgctttcgccttgaagggttctcacaccagacaccgcagatccttgactattcgcagacgcctttgagtgaaggagtcgcgtcttggggatctaccaatcgcttctcgactcgcctcaacatcgactcctctcgctttcggaactgtacccccactaagacacgcatagcgagcactgccaatagcataacgactgcaaatccggcctggatccaagcttgtcgtgacgccatgtacactgcaagtaggaaaggaggacaggccagagtcgggaagagggtgaacttgatggcctgtaggtaatggagccctccagactggctcttggtggtaacgacttggaaaacaaggaatcggtagcagaggttcgacatcgttaagacgaaaatccaaggaagaaccaagacaggtgctattggagccatcgcaagggagagcgcgaacaacacgcccacgtgagggtacacgctctgcaggttgaaaaaaggaggctggcggatttggaaggcctggcggggtgtctgtgtgggtgctggtgcaaagttggcttcgaatgcagaagttgcggatagtgacgatatgctcgaggttcgctgatccaactcgggagtatcgtctaaatcgcggttcggccgctcatccttcgaggatggatgcgacgacctcgtggatttgcgccaagagagaggcccaagagccgaccagagtgtgatcgcgggaagagtcgcccaaaggcgcggcagctgcaaaagatggtacaatggcaggctgaaaccgaaaacaagcgcattggtggatgcaaaggagcaatacgatggtatcgcgtgggcgagaaaatcagtgaagttatctatctcgacaacggcagattcttgccacgaaaacgtgagcgataatatcgggtggacgacgagcatattgatcgcctaagtgatgttgagaaggtgtaacgttggttagcgtcgtggtagctgatagcttttggattcggttcctgcgacatcacggtaaagttcgtgccagcaataccaagaaagcaaagtagaagcgcagggatagcagctctgtctgtgacttcgagacttggcggcagcaatgcgatagcgctatagaaggaacgaattcacatcagtgaccccgtacgcgcagcttccaagtgcttctacaaactgaacacccggccatcctgtcttacctttcacaatccacgatccagcgaacatcaggatggaaagcagcaggggcgccacaacaccttggaccaaataggcccccgtagcagtgggaatatccacttcctcctccgacactctcctccaaccatgatgtactaccatggaagtaatggctgagacagcgaacccggacccgacgaacacgagaaatcctataccaacgacggctacacggctcataaaatgtgccgctcgtgactgcgtctggccgattacatcccattcaatgtcgcgtggggagatgcccaagagtcgttgaacccccacgtactggtcgttctccagtgctgcggtggcaacagccttggctccagctcgagatcgcataaggacaaacgctgagggaaggacgtcgactgattttgcgtcgctagcggcttctgaaaccgctgccaaagtcgctgctggtgcttcactaatgagatttctagccgctgctcgagcctgtcgaagagcggaggaatgggtggtcccagacttgccaggcgattgcatatctgcggccattgcctgaatttggtcttggtacatttgtgcgatctctttgttgagacggcaaacttcgccgcgatagtatcggatggaatcttgccttttgctgatcagcggtaacccgatataacgcgttggacgtcttggcttctggtaccacttcaagaccgcaagtccacttgaactggaagaaacattcgactttcctccattgtcccgcgcggccccatcggcattgtttcccgctggcatggagcctgaaagatccgagagtgagagtttagggagcacgtctccgagctgatacagtttgagatggcccacgtacttctcctcatcggtccccttgcctatccctgcagtagtgcctccgtgtccaaagcaggctttgaaatggtcgacggatctgccaatccaggacctagatctcatgctaagcgtcgttgtggacaccatggccgaagcccgggcgatagcgtccatgtacctcgactccgtctcttccagtctgtccaaggccgcctgtcgtcgcttcacagtcttctcgagcgctgtcatgtcgcgtacaaggtacacatactcaacgccgccacctggggctgcatcaaaggcttccttgagcgtcgaaacggaacggagattgggaggcagatgttgcagaagaactaccctggaggagtaacgcgatgctgcgcgaatgaggtaatcttgtcgcaacttgaggtataccatcaactccgaccatgcccatagaatgatcacggctaaaatgaatgtgaaagtgagtgtgaattaagtatttctgttagcggagacctcggtgaatgcggtgtctaagttttgaagaaattaggttgcataccggaaaagatgatggtgatcatcacggtagcccaaagtcgctcgttatctgtcacatttcctatgtgcaacatttctacgcgcttgagacgtgaaaccgcgtcgagacccgaaaggatctcctcgccagactgtcctgcacagtaaagaggcaccagtgctccaattgccaagatggcaacgatgatggacaatgtcaacagcatcttcaaaaaccggatgaataaatagtgatctaggccaatcttagcaatgacggcttgctgtgcccattcctcggcatctggtgggagcgattgtggattttgcgatgatgtactggaggattcggataagttggaagtggcagggggaacatggacttgaacaccagtctgggaatctgttgtcttctctccctgagccgaactgcggttgttggtcaaggtctttccctgagcggcgttgttggcttctggagattcctcatggaaacggccccagaaacggcctttgccgtttgcctgcgacgatgttcctaattcctgtgcgtgatttggctgcaaggtcgccgcaaacgcgtcgtcgttgccgctttgaccattcactacatttgccgagtcgttggcattcaatcgccgctgctgtttgattttacgctcaaaaaatacaaaactctccatccagctgaagaagccatccggtaaaggctcggcacggtgttcctctcgcataaagaattgccttgagccataaatcgagcctcgtttacggcggacccaagagaataaaataacggccacgatcgatagtaatgatgaaaaaacgatggcgcagtttagagcaggagttgctgtttgttgaaagaagcgtattgcaagcgaatccgaaagtgaatctgtaggaatgagatgtgccatggctgtaggtacaacgatcgggctgctggaagtggttgcgagagtaactcgtctttcatgagaccaggaatgactccccattggcgtcgaagtagccgacgagacgacaagatattgagtattaaattaaaaggatgcgtagtatgagttgggatgtgaggtgcaaagaaggctaaaatcaaggtatagcagggccgggggagagtgggtttcaccagaaggcctgaaaatagtggtcgagaggatatgatggctatacgcgaacgaaaagaaatgtgtggggtacctctgccaccgaactgcgcttatggccacaaagacctgcgcgtggaggtaggagacaagtaatgaagaaggaggcaagtgggcaagaagccacaagaccgagaaaagctggctggtgatatgtgaactgagtgcgtgatggtatggcctatagacgaagggtggaaggatggtagggtggaggggtggaggagaagaaatggaatttgaaaagccaaccctcaaaaaatggagcaatgagccgcgatgagcagtctggaggcgtagcgccagctccacagtcaagctggcagcgaggcgatggggcgatgggcgacggataatggtcctggcatgacctgcttcgagaggcaccgagtgcttctccccatttttgtgccagggatgtgcgcccccttcctcgaagatgccctttttttctctcgtcccttgattgtctctcgcaccaagtaacgaatgccttgacttcggatgccacgttagcgccttaagggactctggtctgtgtctccttctttagccctccctcaagcgcaagacgcactctgtcgcccatctcaacgacaacgggctcctcacccacccctcgtaagacataaaaaaaagcttgatgtaacaaaccgacaacagttcgataaccccctttctcgtagccccttcaattcgccctttctttttctctcgccacccctccttccttttgctttgtagtgcaccgacacgaactgcatacctaattgctaaatgtgcctcttatctaattcttcaatgcaagaaccgagatgccgagcacgcgttgcgatgttagaagtgagggaactcctggagcgaggaagatgagggcaatataccacaagacgactgtcctttgtaggctaatttctctatttcgtagtttttttttttttttttttttttttttcctaaactggcgctggagtgttgtaaacgaattcgagaagctgccgctttgcttcccgcgggtccgcagacatgctaaaaaagagagatgtggccagacactggtcagattccaggaagctttgaaatcaataataacaagtccatgcgcaaaatgcttacttctttagcttgatgtcaaagccgccgcttccgttgggctcaaagtatcgaggaacatgtgcatgtccgtgctcctcgcgctctttggttcgagctcgctgggcgtcctcgaccttacacttctctgctgttgcgaggtcctggttgttgactcgtagcgctgctgtcagtttgctccatagacggcgtgactcgttggcctcctgtttgtcttcagaagcaatgatttttgggtgtatcttcgcggtcttcacatcaaaaagtacatcctttttgagaccctattgccaaatgtcgtgtgtggagattagagatcgaagagcgttatcgtggatcggagggataaattatggtggaaaggatgaacagggaagcatgtgccattataatcatgaagagaagaacaggttgtaatgacgcactatcagcttacctttttgatgtaaatctcatcagaccacttgccagagatttcataaaggcactcgcccgtcgactcgtgcttgatcttgcccgatattccattgtaagatcctgaaaagaagccctaaaagattcgatatgaacaaatgcgtcgttaggcacccatgacagtcccaccttgtgtttttcaccactacagcaggtatttagccctaccttgactttgaattcaaggttgcaaacaaggcctagttttggacacctgatagtagctacatcgcccagttccatgagcatcgtgccgaataagatacctcgagcatagacattcggcattgtaatgatataatcctctccaggtctgtttgtgaaggacaccttaatctcgccctgcatcaacgtcgcggcgctgttgcctaggaattttgattttggaagcaggtctccgagaatggtgaggttgttctctgggctggcataaaagtatgtggagataggagggtgatgggacacttgttcggcgatatagaatgcctccgttccatctgcaaacttccactgcgcgcgaaactgttctccgagaatgggattgtacggtttcttgacaccctgttgcatacacaagcaatatgtgcgctattctgatcagccattgttgtacatggaaagatgccgtttttctcttctctctctgtctctctcaagtctgccctacccttggtttgatatgccatcccgagagatagtaccgagtgaccgcgacgaagcgctcgattggatcgtggatctggtttgctctaatgaatggataaagcgaaaagtgagtattttagaccctttcctttctgcgcttgaccataggcacattccaactggtactatttctctggttgggtttgcagcataggatatgtgaacgagcgtgttgatgaacatgatgatgttgatgagcgggaaatgcatgcatggctcacagggcgggcatatcatcagacgtttgttcgtcttcaccccagccgcgtgtcccatgatctggacaccccagggccaaggacaagaccccctctgccccacatggtccgttacgtgacgaacgccctgaaaagtacactactttagatcagcgtgacacacgcaaaccgcacaccacacaactcctgcgtcctgacgaacaaaccgacacagagagtggtgcgagccgaagaaaagatacagtttccagtccaaacttggtacagaggtaaactttaagactggcgttgcactgccttctgtcagttcacccacgctaagcgacatgtcacctggcttcgcttcaggttcgctcaagagaaacaaaaacgacatgcgatagagataaagtcctgacagagctccagagagaaaaaaaaaaaaaaaggactctgcatcaatccgcgagattgaaacagagttcacggcgtgcagtagcacggaggggggtgctcagaacccttctgctggaaggcgagtaagaacaaacgcaagtgaaaaaagaaggcgctcagcggtgttggagactttatcggcgtgggtgctgcttacttgttgatgagttctggatgtgacataaagtcggtgatgcgctcgagcatgctgcgtggttccaggacaaaggtcgggagcgtgacgcgatggaggtcggtgctcttgccgagttgtgaaatgatgcccatgaggatgttcttcgtgccgtcgtccaggacttcagtgtcctcgccgtcaacaggagggttgggatctggcattgcaagggtgtcggcggtggtgagtacgaatgacagtgtggggcggtcgtgaggagaggtgtgttcctgaggcagagcacaaccccaagacgaggagggcgagtaaaaaaagattttttgggccatggacgcacctgtgcgctcactgttgacctagcgttgatctctcaagtgattgactgtcaggagtgcgactctcattctcagtaggacagtcggtcaaatccctccagatcctggcccagatactgctctatatcatccatgttactctcaaaggcagcgctcgaggacatggacgaaggcgtgccgcttacttcgacgacagagtgcgctctctcaccagtgtccggctgcactgctccacgatgttgctttggatatgagggagccagcaaggttgatggggaccagggcagtggcgcgctggacatctggcttccaaatgaatgcccgcgcggggatgacatatcgtgcttgccactagacagcgctgcctcggacgccgcatctctacttacgctcgatgaagacgacattcccatggttactggtgatccacgacagctctcagactggtccgtcagtatggtggagctcaggtggcgtagggtatcggatgtggtggatggtgatggcgacgaaacgtcatcgagtcgtggtgctacaccgccaactcccgcctccctctgttgcgccagcccattcgtctggttttcatccgaggccaatggtgcggacgttcgtagaggaggcgaacgaatgaattttggatctgggattgggttaccacgcttgacaatctcttgcttgctcttgatagatcctggcgccgacagatcctcgcgcaaggactcttgcacggcgacagataggtcagtggtgatggactcgttcacaacagtcgactcatgctcccacggtgatactttaagtgggccttggatagtagtgcacagcaacgtgaagagacggtttgtgcgacgccagttcacctgcgaggccgacgcctgacaggcggcggtgttgggtcgtgaactcgagagtgcactggccagacaggccagtgttcctgtcgcagtcgctgtagggctaggcttccttgcgctctctggactgcgagaggtctgcatttgctgtcttgcgatggtggacgagtcatggatgcaaccgccaggcgaaggtgtacaaggagaaaaaaatggtgaggttttgccaccaataactgttgggtgccataaggacaccgcgcactccttttctgtccacattgcactccaaattggtaatcacccttgcaccatggcatcacctccatctcactcaaggacgagcagcatctatgtcgatgcaccagagctttccactggatcatcagaagcagtgttgcctccaatcgacgacccgtcacagcagctggtggtcttgtcgtcttcgaggctcatcgatactgagcaggacgacgacaacgacaacgaagaggacgaggtcgagcacgaggtcgagcacgaagaagcagaagtagcctttgacagcggtgacaatgatgttgaggacactactcaggacgggagtcaagatgatgaggaactggacgaaggggaaatacagatggaggttgaccccgtaacgggacttcgccgagcaacgttcctgacccggcgaagccggcaggctcgatcttcttctctcaccagtaggcttcgccgccagcaaaggcaactgtccagagcacgtctgtcctatgctgagcgatcggagcgtccagaccggtcgagttcacaagcaggttcgggacctggttcatcgcggggcgccggtagctcgagaggtggatcaagcgccttcgcaggcacaacgcctgccgtggatgaaaaggcacagagtgagctaaggagaaagatcatggacattcagcggaatcctgatatcagttttgttgacaaagcatcaatgattcaggtacgaaagcgtcgttacattggaggctgttgacaagcagcacgcttaccgcacagtttatttacttgtgccccgaatctcttgttgtaggatctcatgtcttcaaggtggaaaagctcatcaaaaccagcagagcagcaagatagtacaagcctaaccgatccagcagaggaagacatgcaagtaacataccatgtaagacccgttgtcgatgtccgggagcaggaaggagtgtgaagtatgaaaggatgctaagaggattatctcgtggccatcctcctatttctgataggaaggacatcttggatgtcagcattacaggagaggctgcaagctcaaggctaattgctgcggcaaatggttcaattgccgtttttgccatgacgacgcttctgaccacgccatcatcaggaacgagaccaagatgatgctttgcatgcactgcaagacgccgcagaccgctgctcaatcttgctcttcttgcaatgcacagcttgccaaatactattgcgatgtctgtaagctgtgggatgatcaccctgaaaaagcgatttatcattgcgttgattgtgggatatgcaggatcggcaacggacttggcctcgacttttttcactgcatcaaatgcaacatttgcatgaatatccacctcaaggacaaccacaagtgcatcgaacgcaacctggaatgcgattgccctatctgcggagagtacatgttcacgagtacaaccactgtcatctttatggtacatgaagcttttgccccgccgtcctttgtattactatgtgactcttggacaaaacaactgacgttcatcttaccgtataattctttttcacctttagccatgcggtcactgtatacattcaacctgccatgacgactatatcaagacatcgtatcaatgccctacatgctggaaggctcttggagacatgtcaacgtactacgccaagattgactcgctcttggctgaccaaaccatgcctccggagtacgccaacatcttttcgatcgtcctttgcaacgattgcgaagtcaaatccgaggcaccttatcactttttgtatcacaagtgtgacaaatgtaaaggctacaataccaaggtgttggagactttcaagcgaatttcggagggtcagacacacgtcattgaaaacgccactgcatcaggtgctgcggggacagctcccgaaaacaatatctcaggtggaaatagcagtgctgttgctgcgtcagctggatctgcatctgcatctgcatcaggggcgggagcaggcggagggtcttcctcaaactcgaccacaggaccggttacaatgacgacaatggtgtatctaccggaagcaccacgctcgtctctgctggaaggcaacgcagccgacgatgtgtcgttcaggcacggctccaacccctcggggaactctgccccctgatcaatttccctcaccgccagaaactacctagagggaccacgacgcgttactttgtagaaataaagggagtttgcaatacaatttcttttatgacaaagatttttcttttgttgtggtcgtttttgttatagacaacgtttatggtgttcatgaatgcaaaagcgaaggcgaggcagatgtgatgttgtgctgccaccggatcttgtcgacatcgcgtttaaggcccgaatgagtttcaaggacttcgcccgagagttgacttaagcgtatcagccagtctctcagaatctgtcggtagagcccactgctttcgatgtcgtagccttttggagcgcggtgatcagcatagccactcacacggagccacagacgattggatgatgtctcgctcctcaaacaggagcctcgttcctcctcctctaaatcagccttgtccgcaaggtagttcagaagttgtgagatctgggccgcccaagaagcattcatcgataccccatctggctcctgaactgatgaagcgtctcgaatagggcagagcaagttcatcaccctcagattcgcaaatcggcttgccagaatcgaagtttcttctgcttgtaaatcgtcgatatgaacctgctcctggtgctcagcgattaatggccgtcggccaaggtgcggaggcgacagggagcagggtgaatgagctgacgaacggagagggagtgagaaatagcagtgcccctctgtctcactatctccggccagacttgttcttctgctgcccgttgcccgtgggcgtgtggtgagaaaaataccgtcgacgtcttgcgctacatcctgcttcccgattgaagttattgatggcgatgctggctcgcgagatcggtctcgcggcgaggctttactgcaagcactcgtagtcacagcggctagcgatgagagctgagtttctgttaccgtggtcagggcttgtgcaaaattgggcttcccgaataacggtatgcgcggtcggagaaattttggccgtagaagcgccggctctgtttgtggcgaagactgcgatcgcgtcaatgataaccgaggggtgagagcagcgtcctgcaaagataaagtcgatgatatcgacgccgacgataggtctatcgactttgtttctctccttaccgctgatgatgggagaccgattgtagctgctggcgccagcgatgccaatgtgcgtgctgaaaatgcaggcgcagtgcgatgtttgacgaaaaacaatgaggaaggaaagtcggagagcaatgtgggtgttgaacgcgaccgtccttgcggctgttggtgaggaggcgttgatggaagtagaccagggacgggtcgctgcggagccttgcttgcgtctgcatatacagattgatttgagcttttgacactgctgcttcgcagttcctggctttttagaaactgcatcttatcccgaaacgtgattccagctggggccgacgcggttgaatgtgacgaccgtggtttgttgtctgttacaagagcggtcttcagagggaattttccgtcgttgctgctgtcggctgtgtagctgtcgttgtcattactagtatcgttgttgttgtcgttagcttgttcattatcgtcatcgttaagaggctggcggtcgcagtctttgtcacgatgcttgctgccaagatggacactacagccacctgtgtgcatgcatttcgatgcacataaaactgaatctgctgctgtataattcccatcgccatatcctcttatcccgctttccgcacggttcctgtagttgggtatctgtctttgatcctccagggcctccaaacgcaataaaatcgtctcagaatcctttgccattgacaggggtgatgatgataaatcgatattatgggtgggatcagcacttgctctcgcgagcccatattccgacggtgctttggcataacccactgactcttgaggttgagtgctgtcctcaggattggcagctgagtacgatcgccctgcagcaacgatgcctccagaattggtcgccttatcagtcaaggtggataatgttggaaagatcggcgaggcacatccctctgcagatggtgtagttatagacaacatagcttggaaagcagcagcgcaaggcttctcgtgattcggcagacatgcagcgcatccgtcgtccgagctcttatcaaaagctctatgcagagcatcgggcataggcgcagggtatattggtgatgagggtccagtagaaggacgtggatgagcgctcgcagcctctgcggttgcattgtgatgatcacaaatcgatactggaccatgactctgactgctggactccatttcctgacggctctccatatcgaatgccggtagtagaggcgatgtagtattcgattgagctcgaggcttttgcgagtttgcatacggtgcaacggttggtgtatcgtccacgccatggcttgcatcggatgacctggtgccagcggcatcctgtttgtcaatggcgcccgcgtcctgcgccaccaatctctttcgtctgaccaatgaggatttgggcccgctattaactcttgtggaacactcgcgctcgtgtggaagtcccaaagttatcgttgtcgaggccactttgcgtgttatagtcgtggtcgtggtcgtgatggcagtttgggaacgcaacgacgatactcttgtcgattttgtcagcgtcgcttctttacaaggaccgctgctgctcttcagttccgatgaggtagtattttgataaaagccctgcttgctgcggctgctgtttgtggacggcgtactttgtgctctcagtgatagcatacaactggagtgaacggacagactgcatagtggggcatctttggagcatgcctttgtgacccttccagggcgagcggagcaaggctgcggacgcggagctttgcttgtcgaaggtcgactgtaattatcattcgaccgcttcatatcgcaagaccggcactccttgggtgcaggaatacttgtcagaccaacattggagtttcgagaacgcgaagcagttccaattcttcccctctgactgatcttttcgctgatgtcctcacctcgccgctgatcgtccttcgtgttgatatcattgatcggaggctggtcgaaactgtggggcagaggcaatggcgatgaaggtggggactgcggcatggcttctcggtcagatgggccactcgttgtatggaagggtactgttaagcgcgaaggcctcccgctgttattgagtgtcgtcgtatcatgctttccgggtcgcctgttctcaaggaaaatcccaggacgtccctctcgctcacctagaggattcgtcgatgccgcgcaagaggagactgatgaagctgtgggcggagtagacaagccccttacatgccttctgggactgagctgggccgctgcgaacatgatagaacgacttttggtggtttctgtggtcttagaagtaagggaacgcgtgcacgtccgttcagtgagttttgttgaacaggataagaacaatataatcctccttgtgccttacatacttcgctgtctcactcactctcttcgtcgacatcacaatgaggtggtcgaattgacaatggaatggacggcgagatttagagcagtgctgccaaagagaggtactgaatgtacactcagaagaactgctgctgaagctctttcatacaagcgacaagtgcaggtgaagtgtggggggttcaacgaaatgaaagaggtgatatcgatggaatgttggcccacgcaccatggtttattaagcggtggacgggatctgtaagtgtggctcgccagagggagtgatggtgtcaggaacgagggacaggcgagtgctttttcaaggagcttcagcatctgagcattggactaattcgatatgaacaggacagccagcaattttgagagctggagtaaaaatggacgtgagcgccaggcggtagagatgggagcagagcgcaaccttcgacactcactcgtccacgcatgtactcccttgccgccatccacgtccgcagagcgttgcctcgtttgcaaaggagcaatgctgcacacatcaaaactattcctaaacagcggcatagttagggcatgcaccggtgaaaaagcgcaaaaggttactcagccgttgagggcgggccatctttatacgttgacagcctttgcatcccaaaaacaggcgtggcatatcagacaacgctgctgctcatccctggccgccaaatgccctgcatggacagaaaggctgctatcataacattctactttgacggctagtgcagattccgagtgcagtcccttatcacacggtccgcttgcttgatcatcggctgcagaatcccaccaaatgggagaagttgtcgtcaagcatctcgtgcaagtctctggagccgctggcggcgtcgtgggcctcgtacctgatcccttggatgtatacccatgcttctgccaagaggacgctgctcctataccagggttcagggccgtgaggaggcggctcctccgcatggcgttcgatatagacacgtcgctctgcttgtaataatgagcataagtctgcagcgcgtttcgatccgtcaatgcatcgggctggtctcggatatggatgaccttacgcaacgacaggtcgtggtttgggcaccaaatcacgggcaccatcaacccgcctttgacattcttcgttggctgcatctcgaaggcgactgtatagccggcgtcgcgtgcgcaagtgacatgaaacacccttttgcatccttcgccacatgccacgcaagctccagctttcttcttacaaatagaacaggcttgtctccaccgctcaggccgaactctgcccatcaattcaactgacgatagcctgtccgcctcaacaaagttgatttcagggatccacatagcgcaaaggatatgggcccaattgctccctgtcgtctgctttaaagcctgaggaccttcatccgaggatttggtgcacaagacacaagtgtatgcctgtgaagattgttggcaataatagaacgcggcatgtcaatccactatgctcattatagtatgcaagaaaagcattgaggtagcatgtgtttaacgaagggatggacttacggtggagcaggttggactctggctgttgcagcaggtatcgcacaaccacttgcggtgcggtaccgaggcatcaactccatagcaatctagtcgccaaaaaaaaaaaaaaaaaaaaaaaaaaaaaaagaaaagaaagccgagatcagcggataggctagatggatacattactgaaacataagcgaggtgatttcgatccacctaccataatggactgtgagattgcagtcaacacaggtcaacagctgctcacctcgagctgcaagatccctgcatacggcgcatgggagttccggcaatggtgacggtgagcgcgtcggctcgtgagactgtgaattgcaaatatcagcttcggttaacgtgctaacaagggtacaacaccggatattgtgcaagtgcatacatcaacactccatacctgttccttaaactttttggcaacacttgtctttgcctctaaacgctttcgtttcactgctgttgcagcttcagaagccgccgccgaagccttgttgggcccgttcatgagtactttggctatcatggcaagcgctattcttgttagaaggcacctttatccgaagggaactatcgctataaacatccggcacttaccagatggatcttttccttttagtttcttgatgtctttctggacgtccgccaatggcggcaaagccacgtagcgaacccagtcattgccgcagtcataacagtacactctcgggcactgactctcaggatcggtctctcctggtaatcgtcgccatatagacgtgactttggtcccgcaatgcgcacaagcaaatttgccggcgttatcggttgatggcaagataattgtctcataatccagcactgaatccttcggtagctcctgacctgtttttgagcgatttccaacctccacagcggacgaagttaccactccacgtccgacagatttgaattttttgctgcaatgatttacggcagtgaaagacaacggggttgttagtttagcctgtgacataaaaggcggattagctgttcacacgtacgaactctggcttacttactttggtttgtggatttttgtgaaaaccgaatacacgggctgataccgctcagtttttttccaccgataaaaaaaccgaacgatgtccttcatagatcgtgactcgacctttttcttgattgcgaacaactcgtgtccgtacagtcggatgccctcttcaaacgcctcgacctcctctggtgtccagtctttgacgtcaaggtccttttccttaagtagggcaaggtcctggagggccttgtccgcatcatatcctgactgctccaaagtcagcagagccctatcgatgacgtccgcagagtggctaggtaggggtagagccagttctttcacacgctccatatagccagccactaatggacaaataatcgaacgaagaaaaaagatatgtcagcacagtttttgtccacttcatgaaaatggcgtacaacatgatggccagctccttctttggtcgtctgcattgctcttaccatactcctcagagatatgacttggctttaaataattcaacgtgacggtgtcactacctccacgctctacatgtacagcatcatctgctgcccctccagatctcgcaggggatgagggggtcacgggggtgtcaagtccatccgcagaggtctctaatgctgctgaatgagcccgtgagcgagactctgcttctatacagtcccaaatgaagtcaagcaagataaggtatcaggtccgcgtacgctggtagagcccttctatcttttgagaaataaaccccttaccctccggcactttcaatctatttgatggcctgcctccgcgtccgcctcgccttgagcgaccttttagtgaactactgtgaggatcatcaaagattgtcgatgtggccagcacctgccctggcccatcccattttataacaacggcctgatatttcgttccaactcgactcgaggctcgcgggtacacgcggtcatcaggatctagagggagtccaaaaacagttgacctgtaagtaatcctgcgtgccaagcttgagtccaggagcgccaagttgttaaatgtgcataccgaaaatgtcttgaatgtctgcgtgagttccaaagtaccggaatggccacatatgggacattttctgatcctgtggcgcgagaggtgctgcgggagtcaagtaatgcgggtcctgtcgagtagatttttttgcactgccctggctggattttgtgccgccattggccgtgggaattactgctaaagtcgacaccgccttctgctttggcgaccctctaggggaattctgtcctgaagttgaggcggaggtgtggatatggatagcggaggtgtgcttttggagagtgggcggagatgacgcggtaggttgagaggaagaatccatggctagcttcgagcatagtgcgcactggaaggcaaagcccttggagggttttttcaacatgggtgggttgatacagagcatatggtgaaagccttgacacatgatgcacttcaaagcttcaccgctggaggagataagtttggatgttagtgcaccttgaaacactcatccgcgcttcatattacacctccacgcccgatcactcctgaatccatgggccgattaagcagacgattacaatgtctgcattccataagatggctcagccgtcgtacgagtaagagtatggaatggaaggcgcgattggtgtcctgcaaaacgagctgattttttctcgtccggtctcgtgccatcgcttgatctccggacgcagcgaacgccgccaacgaggacaatagcaaggtgcgtttggtgtaggatcctgtcctgccagtagctctcgattgctgagatgcattgtctttacacgcttgcaacaaggaagtttccagcactgccatgactgaatggttcattaccttgcacaccaccgcttgcagatgagacacactctatgcgcatccgtgtactctgatgctgttcctgcctctacgacaatgtactgataccgccggctgagctctgttgccacgtccagcgggaggttgcgcacggaatcaaccggtaagacgtcataaaagcgatggatgtatcggtcaaagagctggttgtaataaaagtggtcgggttgcttcctgtaggattcaaggtccttgatatatgccagatgtgtcacgatacagaggccgcggatactggagatggaattcatatcggagtgcatggttgcaacaagcaggcgggagtcagagttcctacgagccatgacatccttgggacgataaaaccaaccaattctgacttgcaaaggcttccctttcgtttctttcccaaactccatcactcgcccaatgtaataggattctcctatgaactccgaagccatgtacacatgatctagtccagtgaaaagccgatcgagcagaacagtgtgttagatgcgaattttccaagcggcatgacgaggatcggatcgcagcaattttcaacccagagaagtaggagccgtgtgatcaacaagcgttttgtctataacgatagcttcacatccagcgcacaggctgctatgcatcatgattcggttctcctaccattcaccgatatgagagttccatctctcagtggggccgaggagatcttgccaggcgacggaccggccatgatcagtggtgtgtatcagcagaccgtcgttatccaacgcacggacagtgactcggcagctgggctgatggatagcgtttcagactcgctggctagctacggcggtgggcggaagaatagggcaaggtggccaatcgctgcagcaagcaaaagtcggcgatcgggatgtgggggtggatgagacactctgctctggacaaggcaccaaggatgggtgaggagcggaagagaaggatgggcagcaagatggcggaaggactggagatgcagagcaaaggaagtgagcaccatgaatggagcagacaaagattgaaaaaaagatgcgagagcagacgaggtggaaggggcagttgagggggagggagcgagaggcgtgaaaaaaaaaaaaaaaaatgacaaacacacactcacacacacttgcctcttgtccgacgactttggcggcacccaagggcaaaagatatggttgcgcatggctacaccagcttctgcttcgagatggaagacactccatcccttggcctgcctggtcagggaccggccctgagaagcagcatgtctcctggaggtggtccccataggccgacaggcaagagccgatagcgatactgtttttgcgtccgtctgtcccatacaggctgaagggtggatcaagaataaggttttcgttttttttttcttgtccagtgtggcggtgacgacctgggtcaattttttttttttttttttgtcaccctggtgggatctggtcaaaagtgtgttttttcctcctgtccttctctcaccattccctgtgccccatcccgcttcggtccacgtacaatcgagtcaagacccatcaccagaccacgcgctgagtttccaggacctgcagcagcaagacactgacaacctcccggccctcggaatctgtcaagcctcaaacaaacgtcaacaccgcaccatgacagacaatccataccctgttggcgcaaccgtccttgccaagctcaagggctatccctggtggccagctcgagtaaggaattgctttggatcagatgggctgtgaccagcaaaggagtagaagaaccaacagagaaacaagaatcagggttgaggttggggaacaaggatcccgaacatggcatgagacgcgtttcttctggctgaagtaactggcgttttaacaatgcagactgcttcaccaaccaattcttatcggctttggcttgcctgtattttcttggaatagattgaaagcgatgcagacttgcctgcgaatgtcgcgagcaagaaacccaagcagcggcctatctggcccgtgttcttctttggttcctatgactagtaagtaccatggggaggaaggagggcttttccgacttttccacaccatcaaacgtatcatgaactgatccggctacacctggaccattcaacaatgagctggaagtggagcaatgcaggagctgcggcggtagtcccttgttgggagaaactcaagcacatcaccaacgccagtgccgtactcagaagtcgcgcagtaggcactcactttgataaaaaaacaaggcctctagcagactgccgtcacaggagacagcggacgcggaccactgtcgtgggacaaaaatgcgcaaagctggtttatccaggagccatagcgacagggatgagctatacaccatttgcaggacggcgttagcgtgtgcgtgtgtatatccaagtagcaatctgagcgagagaattcgcaggaagaaactctctccttttcagctatcgaatctgactgggctgtcttttattctatccactctgtagcggttggtttgccgcgtcggaacttaaagcattcgaccccgcatcggcagccaagacaatgtctggcatgaggaaggcgaacctgcagaaaactgcatatgcggaagccctcgatcctaatttcactataggtaggaccgatggcagcgagccagaggaggaggacgacgaagaggacgtggaggacgctgctccggtaaccaaaaaggcttcacccaaatcgaaaaaggccagcaaggcgagcaaagcgagcaaagccggacctgccggtaagaagagacaagcgagtgaatcagaggatcacccagtcaaacgccggacatctaaaggagcagctgctgccagcagcgaggatggagaagacaatgagttagccaaggtaagcaacctgcgaggtatggaatactggaaagccacgcggctagtaaaatatcacactgtttactgacatggcgatctctagtcaacaaaacgtgcagtcgtaacttcacgagccaaagtgacgtcggaaaagagaggtgtcgaagatgaggctgtcccttatgaaagtagcaatggccaaacgaggaaatcggacgaggacgccggtgattccggagaaggtcgcaccaaaaagaaactgaagagtaagcaacgccagcatcacccagtgtaggtgtgactcgcgatcgaatcaagtttgctctcggttttctaacgccacgtcttgaattatccttgaatatcacaggcggtcaacccaacgaacgccttttgaagttgcgacacaagcttcagaagctgctgctggtggaggggctatcagacgaggctcttgctcaggtatgaaccctatcgttttgtgtttcgggagatgggattgcgaacggaggcaaccgacatgtactgagtcatcttttcaactctttgatgtttacatttgagtagaatctcgagcgcgcggacccgattctggcggaagtggaggctttcgagattgatttacaaatgctcaaggttagcggtgtgcagacgagagcgaaatgctcaggaaggtggcgctcagcctgttctaatatgaattttcgtttctgtttctaggacaccaagattggtcgtctgatgaagaagatttcggcactcgagtttagtcacgatccgcaccacatcgtcgagcgttcgatcaagctgatcaagcagtacaaggttatgatggagaaggcgcaagagaatggtgagggcattggatcgacagcgaaggcagcagaggccacaggacctatcaagacaacggtcagcttcaccgacttcaagaacggtgactctgaatcggctctgttgagcaaggcaaagtcgcagtcgcccgtcgtcccgacccatatcctggatgtcccgccgattccagaggcagtcgtggcggcagttgcagcgattgttgaaactgatacccttcccctaagcagcagcagcaccaagggcatagctgagatcggtcctgttgacagctcacaagtctaagcttgactttccgaaatacactgccgactttcaacatcttttctgtatctccagcaacgctgggcgtcaaaacgtctttcctaccatattggctttgaagtgaatagctgtccatcctaatattcggcttgcttggtgctatggcctgcggtccctagaaggatgtaactcagcatccatgggggtcaagagggttcggagagtggagaccgcaaccaacgaggagggtctgttttagataatgtcgttggagggcaagcctttttttggtgcgtataagagtcacgacagccaaagtttgagctgcataaccctctcgcagacccttcgctttttgctacctctctcaatctcatttcaagggccactcacttacccgtacgcgcctcatcatgtccacaaacgcatccgcctcctcaagactgtcagtgatgagcatggccgcctctctccctagcgttgggggctattcatcgtccactccatccatttacgggaaacgcgccacgaccaacattttggagcgtcatctcaacaaaactcggggcacggaggtattgtcattagtgctgcatgacggggtatcatcctcgaggctcgcttaagtcagccttgtccaagtacaaagcgggaagagattgtgcttcaatgcagacattaataacacttttcggactttgactgtactaggtgagcgttaacgcattcgcctttctcttttcagagatgctgcaatacacgcaaaaacgggtaaacggaatacaggatttggaaagaaagtaggctgacgacacactgcattttacagaagacactgccaagaccaacaagtgcgagtcaaattatttgcttgctgactctgcggatatcctcaaatgctaggctaaacgaattgggatacagggtcggcatccgcgcattggaccttttggtctggcgggataagaacagcaaacgcgaaacgcgcgtactcggcatgctatactttatacacaccgctgtttggaagacaatgtttgggaaacaagccgactctctcgagaagagcacggaaaatgaggatgagtgttagtataatatacactctcaccaaaggaaacttcctagtcgacaatctgcactttgctgaacctctctctgttccaatttgatgcctccacagacatgatctcggataatgatcctatagtatcgaaattcatctctgtcccaaaggacgtgtcccagctgaactgcggggcatttatggccggcattgtggaagcaattatggacgggtgccaatttgtaagtttatgaaccggggttgtggagcctttttttcctttactaatttctcaactgtacctattcatcgtagccatcgcgtgtaactgcccatacagtgccaatagacggatatcctcttcgaaccacaatccttataaagctggacaaagaagttttggaccgcgaggagcagttaaaataaaggaagaaagtagccattccgttaccttacaagcaaggaaacaagagtcttttcggaactgttatgcgcagaacatttggcaaaggcagcattggtcttctgcatgcccccggggattctcattacatcagagtctgataagtgccgcgtctcccgctccgcggcttcttctgcagagcaacctcttccgccgtacatcactgacgtgtttcaccagctgccaagatcacactttaaatgatacatcagcagccgtggctggctctttgccgttctagctttggcccttcctctgcctcccgtcctctctctctctctctctctctctctctctctcccctcctcctcctcctccaccagacagagggtagggaaagaagcgagtagagaaaacgagacgacgaaagccaaaaaggtacaaacaggaagagacagtgagacagagaataagacgagagaggcaagcgaaggccgctgaagagcaagatactgagaacgcgacgagagaggcgaagtagactgcagaaggaaaaagtggacgatacagagaacgagacaagacagacgaagaaaggctggagatgaagagtgaacgatacacagagcgagacaagagagacgaaggtaggctgcggacagagagtgaacgagaacgagtcgaaggaggaaacgaaagaggcgaaggtacgctcgagaaaagagagagaaagcaaggaaagtgaagacaaggcgatggtagagaaagcgcgtaagacattctattgatcactctgcagatcacctctcgatatctcaagttgataggccatgccaagaagacttctatggcctgagagaagcgacatggtggtgcgtggctgcatgggtagctcacgggcggatgcgtctgatagcgctacatccttttcgatagtcgtttggcgactacaatcatctccctcactttttattcagtgtgcccagcaacagcatgggacctatagttgaaaagtaccatgacgtcatagtgcgaggatttaatgtttgaaggaaatacatagtcatcgtaaaaagtggggggtttttttttggctatccagcaccattcctatcgaattttagtccctactgttattccacacctttcaagaacacgttgagcaacatctcagcattcgagatcgcgagaatgagttggaatgtctctcgtttgagaatggatgtggtcgtcgcgtggtgcacttgagagacagcggagaagttgcacaggccagcgaatcagatgcagggattgtggcacgacccttccttcccgagcacgcatcaaatgaatagactttgattgtgtactctccttttttgaggtgtcgcctgagagagaagtcgctctgttctcgggaatggccccacgtgcagagcgtttctgtttttctgcttctttgccttctcacctatcactctccccatgccgaaaaatgcctctttgtggctgccacacgaccacccccactctccttttgtcaagggcggagtgagctctgagcctgcagtttgtttgcttgatgataatgggatcctctacagtagacttactgttagtctccagcgcttatcgacggcagtgaaaagtttggagagctgagggcagtgcgcatctgtgagtgctgtgtccaccgttgccctctcgcgctctgtccgcacactgcagccgaatggcatcacgtttctcgttggtgcacgttttctcgttggcccaaactttttatatatctcccctttctctactgcgttctttttctttcttcctcttcaccccttccacgacgctgcttttcgccatcgctgtctccaccttgtacatcaccacagtgtcaacctcaacaccagtctctctgattcttctgacttgccactcaactttcacggcactccatatttagctttgcttttgattctctctttgtgttaatttgttttcacttgcttgcctttccttacaacctctatccatcatcttgtaatcacagagtctttttctatcgttgtccgtacctcctgtataaacggcgcagctatgcaatcttcggaacagcgatctcctcctcctcaaaagacttcaaacaccctcttcaaatcgatagctccagttactctacgcgacacatcctcgacaaagcctcaaccgctcgtcaaagcgaaacgtcaaccgactccagatccttcacctgtcatgaaccctatggacgttcaaggaagtagcaccaaaagtggttcaagcttcgctgtctcatcggcttcgtcatccagccctggactgcgctctgaacaaccagcacctagcggtaaggcggtctgcctgagaagaaaaacattgctgtgcccagcaggacggattggcttcttaccctttcctgttgtaactgccttaatccgtttagcttcattgtccatgttagcatcatcgtccaatgcacgtccggtgcactcgctttacccgtctgcaacgcctcccttgtctcctgcacatgcactcctatctccagcagctaatcctcactacagcaacagcgcagatcccagtcagcaatcatctgcgttttatcagcttcctcctccgttgcagtctttcagatcacacgatgctgtgcatcattccccgacattgccaccgcaatattatcaccaaggccatggcggagtgctgcccccgttttctgttccaaggacgcctcaaggtctaggaagcgagggttcctctccaagatccattcctcgccagtcacctcacatgcaccaccctgtctcctcgccctcgatcggtccgctctcaccctatccaacgccacaacatcatccgcagcatcaatccagtccccaccagtcgcctcggttcgagggtcagcagaccaaacatcaaatgcctcctaccatggccttgcctgcatcaatgtcatccacttctgtattccaggtcttgccacttcgacctcattccgcacattatccagcgaatcatctcgcaaaaaacggcccgcatggaacacatctcaagagcgctcaaaatagtgcaccaaaatcaccgcagcggttcatgatgcttccgccgcaaacggctcctaccatgtcctcgactcggcaatctggatcacagtcaaagacggcgactggtgtgagtcccaaacgtcgtagctcctccaacgccaaagctgtcgaccaagaaacacgagaaaaactgcggaaagtgtctcattcggcaatcgaaaggcggagacgcgagaggattaatgacaagattctgcagttgaagtatcttgtgccagcatgcgtggacgaggaccatcttcacaagctatccattctccagagtacgattgagtacatacaatacctgaagtctgttattccagagtctgttgccaatgctaccctcaagaaggctaccaacgacaatcccaacaacaagaccaccgatatgttggtcgctttgacaggaccaagcgcaggaccatcgtttgcgccgatgatgaccacaggactggggcagccctaccaaaagaggccgagactggacaatgaatcggactcatcacagcaaaatcgttcagcagcatgcttgccagatacgccacacaaagacaaaaggcgcctctcgatgccgccatcaacgtcagatgaggatgccaaggatggactgctgctcttatctcaactgtcttcaggacatctttcagctagcgtgtccccaactctcgctccacgccccggcgcaagccaaggcaagagggcaagcaagagcgagtctacaacatgcgagggcagacgtgaggcagtggatgaggaggacgaggatgtgcttcaggacgattctgaagcgagtgacgagctggatgatgaggattatcgggatgaagcggtcgaggaagagcgaatgtcggatgacagtcaaggcgacgcgtctaggaggagtagtaaaaaaatgagtgtcatgcaaatgctctgctgaataaataccgccacattatttcctccaaaatgacgacagggtgggatttacagagaacttttttgaacctttcggaacgtctgattgatttcccctcccccttcattctcctctccctctccctctctacgttcatccctcttcccctccccactcttttcatccatctcatcatggcccccgtcaaggaaaccacccccggccccagccctctgagcgacatcaagaacttgctcaaggatttgcacgagaaggtcgatcgtctcgaggccaaggtcgacaaggtcgaggccaagggcattggctcgaaggacgaggaggccaagcgtcttcgcatgatcctgattggtccccccggtgccggtatgtagtcccatcgggactcccctctgctcctctttttgcttgttgtgggttctattccacatctccgttgtgtgtacccctttgtcccaaacagctgtttttttctgatctatcaacacacgagctgtgtttgtcaatccaggatcgcggatcggatcgcgtttttattttttcatcttgcacctgttcttcccggcaacagatccaactcatgggtagccctgaccaacgaaactctgtggtgggcttgggatgtgagattacgtaaagtacaaagcggcgacagcaggggaaacacaagtagacggctggtcttttttctacaggtgaaagaacgattctgggtgttttttcccttctgcttcatccatttcctgatccctatgatcatggttttctacttctttatttttgatgggggtcgagaagggtgtacaggacgcattttgagtctgatcgccgctctgagataaggacttttttgcgatcgagagaggaacaaagtcggccacatgggaatggtgggggtctggctcagatttttactattgcgtattctatatcggatcgatgagcgatcaaattgcgtccagggccgatcccagccacaagagccggccagctgcatgcgctgtttcacatggaaatccttttttatcaagcattccaacgtttttttttatgattcttccacttgccttgcctctattgcctgcaacacgcatattcgttgccacatgaatgcccctcttcttctatgcgcatatcttcctgcctcatggccagtcgacctccctcacctggctctctgtacaccatcgcaaccattttgatacttgacgactgatgcgcttgcgataatcctctgctaggcaagggtacccaggctcccaagatcaaggagaaatactgcgtgtgtcacttggctaccggtgacatgctccgtgccgccatcacgaacaagaccaaggtcggcatggaggccaagaaggtcatggatgctggtggattggtcagcgacgagatcatggttgatatgatcaaggacaacttggagaacaacaaggagtgcaagaacggattcattcttgatggattccctcgcaccgttgtccaggctgagaagctggatgccatgttggatgctaagaagcagtccttggacaccgttatcgagctggccatcgacgacaacctcttggtctcgcgcatcaccggtcgcctgatccacgttccctcgggtcgctcctaccacaaggagtttgctccccccaaggtccccatgaaggacgacatcactggcgagcccctcgtccagcgttccgacgacaatgccgaggccttgaagaagcgtcttgtggcttaccacaagcagaccgtccccgtcgtcgattactataagaagaagggtctctggtcccaggtcgatgctgctcaggaccccaaggtggtctggtcgagcttgttggctatcttcagcaagactacgggcctttaaagactctcctcgcctcctccctgacttccgtcactccccttctccccccacctcccgcttgctcgcttttatgctttcatctctattcaagactataataatgatgctatgtcccagtatggagattgaatgatctgtagatattttttttaagtacccagtaaaggtatttgttcgaagattccacaccgttcctacaggggttgcccgttgtgacttgcaaatcgccaccaaacacttgattgcagaggctaccagactccctcttctttttttaacaccacagcagcaaaaaaactccacgaactgcctacagctgttaagagcatacaacggaattgccaggagcaccaggaacaccaggagcatcaggagcagtaggagcccccggtgcactaggaagacagcgagctcaacatggaatcggtcttccctccatcgccccagtggcatcaggctcattccgcatgtctctgctgtgtctctgcagacgttggctggctgctgtactcgctcaataactcgatccacatcctcaaccctttcacgctgagataccaaggcatccttcagcgcggtcacacagccaggatcaattctctcgcctcgagaccgatcctccagcagatcgctctcccagagcctatgcacgacgaagaggccaggttagacaaggatgaaaaattacaaccacacgaccctttattgcatgccccagaacatggcgtgacctctatggactccacaactgcaaaagctcagcagggaacctcacctcagagccagagagcacttatcgcgtctggtggtgacgactccagggtcgtgtgttgggatctcgctgcgcgcttgccgatcgctacgctgacaaaggttcaccaggtagaatattactccagcagcaaaagaggcacttcctcacgcgtcttttgtctttttcggctgggccaacgcaagccacgactaacgctccattatttcactgaacaccataaccgatgcttagaaagttgtcagggctgtcgagtggagtggagatggacgccatattatctctggtatggagcatcatcataacaaactctgtgaatcgaggaagacaagaggctcggatatgaagtttacccttttactaacggtttcaccccactgcatatcgttcatatgaaccataggcgacagaggaggccttgttgtggtgtgggatccttttcagggcaagacccacaagaagattctcccagagaagccgagcatttcatgcatcagcgcaagccctacacgtcctgatatagtggctattgggtgagttgagcaccaaccagacgtcctactatccctttgcgttgtgaccagctgcagcgaaggtcgttcactgatctttgatccttacttttcattattagtctggatggaggtgatatccttctttgccaggttaatatgtcaggcattagcgtgcacagtcggttgcatggacatacagacaagatccagagtcttgcttggcaaccatcaggtacggaatatacattgcttccaagatgtcagatacagatacatgcaggtgagggtgatgtgactgaccatgaagggctgtatccacgtatgagtaatagtttcgggcaatccagtatatactcttgtggcctctggttcagcggatcaaaccatcagggtttgggacgtggagaaagtcgtctcgataaaaacgatgcgcatgccagatgtcgacaataagctgtttcctcatttacgatcgaggatttgggttcccgttggctggacatccaagggccaagacatagtttcatgcaccagccggtacgttcttgtcattgaactttttacgctctactctacccagctacttcatcactttcaatacgcccacctaatgcaaagatgttggtctcgtgtatgtattgaaaatagtggtgtcatgatccgatggccgttagagtccgagtctagtcagtacagcaaggtctctaggggcaaagtgcacaaccgcaacgtgttccagatcatgacatggcccctaggaagcttcgcattcacgttttccatggaccgcaagatcattgcctgggatatcgacagcaacgagggaatagcacagatcgattgcaccggcgggaacgtctatgcactggatatcagcccgctagatcccggaaaggtcgccatgggactcgggaacgaggcgatcaaaatctggaacacgcttagtgacgaagcaccctacgactgcattactatagagcgtcttcaaagcaaagttcgcacggtcaagtggcatcccacagaggaagggacgttatgttttggactcgaaaacggcaagattggcaagatcgagcgtgtgttcagtccagcgggggttgatcatgtacataatccgaatcagggcaagaggaggaggaaggggaatcaaggccaacaaacaccgcatggcaagcagcaacaacaaacccagaccattttccagtcttaccacgagaaggctttggtctcgatgacctggtgcagccccaaggtctttgaggccccggttcctgagctctttgatctctcactccgggactccacgtactgcgtaatttcctgtggtagcgatggaaaaatccttgtcacagacacttcaagaccaacaaacaaaagcctagatctagaggtcgtccttcaccggcaaaatgcggattggtaccagtcctacaaggtcatcagaggtgtcgaatctgtggaaagacgagacgtggctgttcatccgaacgaggatttaatggcgatcggaaacgccgacgggtctgtggaggtgttcgagttgcgctacttcaagctggtctacgtatatcagggacacaaggcgcgtgtcaatcgagtcatatggaactggtcgagagactccgtagaggaaacgacatcggattctgtgacttggtcgtaccttttagccagtggatccgacgacggtgcagtggcggtgcataagctggatcagttctcggcctcggcattggagaggagacgacgcagggagaggcagcaggtgatgtcagagactcggccggatacacctgatgcacataactcggtgggctcggcagcctcgacggcctttgcagacgcgaacatgatagtcccgatcatgcatgcgttcgccttcttcaagtaccacaccagaggcatatcggatattgcctggtccccccacggagccagtggcgactcgatgtctgttcatactcagaagctcgtaacggcttcgtacgatggcaaggcgatcgtttatcagatcctgacggacgatgttgcaaaagggggcgatagtcctgcgaccaacctttcagcgggagacaccgctgtacctgcgagtacaagccttcgcccccatcggcccatcgcgtgcttcgatcagcatgagcaacaagttctgtctgtccactggtctctatctgacgtcgacactatttacagcggaggaaacgactggagggcatgcggctgggactggaaggcgcatgtagtaacagccgcgcaactggatgaactgaagcgaagcggcaccaccaatcctcaacccaacgaggccaagaaagctgctcccacaaagtcacaagcgatcgctgccactggaaacatcccgagtgtggctgccggacgaggaccggacggtagtgcgacggttgaaacgagtactgaagccgacagcctaaagcatgacgttgcggcactcccaatcgacgcatgcgccgatggagtgcatcaaccgacagtgactatcaagagaagagctgacgagaacctagcgcaacccaactctgtccaaagcaagcgcacccgaaccacacataccgacacccattcacagccctcgaaatcgacaacgacaacggtggtggccaagcgggttaatctatttcctatgagtacggccgcgtttcaagtacatgccaagcagaaggtccatttggagatcattcgtttggcacgcaatctttactgcagacgaacgcggcagggaggtatcctgacaaccgaggatgagcacagggcggcaaagaggcgctggcgtgccatgcggcagttctttgagagagatggcgagcgtgaaggtcaagaattgtcgcgcatacttcaatctgacaccgacgagatgaatctgacagacgacaatgatgacgatgaggacaaggatgaggtccaccagaaactggatgtgttgaaccgggacgcggccgtagaacccacggacagtacaaatgcttcagggcaggcggtttcagagccaacaaagccattggagtcttcaggtgctgaaaaaaatgatccagctatttcagtgaacgacaacgttagtgccactgaacacgccgaggactggcacaaagaggactcgacaagctcgatcggagacctacttttttacggctcaagggagtcgatcaaagccttggcagagatggaggcgcaggagatgtcgggcctgggaccaagtcttgcccagaccagcaacatttttactgttggctcggggatgggtgttcccgctgtacatgttgctggtcaacgagaatcaatagcatctaacgcgagcacagcacggttcggccagatcccagtttcctactggctgggggacgttcccaagatggctgaccttctaagctcggtaccagcctccgaaatgggtgttcaggactggattgggttagcgctgtcgcctatgggtggagtcgaggtttggagaaccatgatggccggcatggcgaacaagctggagagccgcggtgatgtgcacgctgctgctctctgttacctaggcatcgggcgagtctatgaggctgttgaggtgtatttgaaactggggatgtaccgcgaggccctcatgctactgcgcatccgtctatggagcgactacgaggacgaggatgacgagggttcagatgaaggcggtcaggaggatgtgtgtgatgagcggccagaccaaaaccctggaccagtgcagccctctccaggaaaggacgctagagagctccacatccggatcctaaccgagtggggacagcagatggagcgccgggggctgtacgagcaggcgtgcaagtgccagctgacattggcatccatcctacgccttaagcagcagcagcggcagcgaaacaaggacgcccaatcccacgaaagcacagccactccagccttgcagaccgcatcgtccgtgggcctgcagacgctcgcgcgtcgaggggaccctgcaacgcttcggaccgtggctgctctggccattttactcgacgacccctctcagcagcagcgcatccatcagtaccagacggtcgttgctcagaaaagagaggcggaccgcagccgcaagcgattgcatcaggaaccctaagtcagatggggtcccacctttgcattaaaagcatttttcaaagaggcacattttgatctatgtattttttggtcttatcaccctatttatgcctgagcctccgtctcttgttcctcagcaatcttccttcctgcatcacgctccttgatcaagttgcggaggtcctccaaacgctgctcaatcttggggatctcagccagcttgtgctcgagcacctggcgctcctcctggagggctaggcggcgctcagcatccagcttggtgaagacgtagccgccctgaccgtcgtattgaaggatgtactgtcatcatggagacgaagtattcaaaagacggagtgttagtcaaagataggcacatgttcacattcctatgaataactcttatgaatcgcttagtctgagcagaaagagaaacttacgttgtggtactgccacagcgagggacggtgggatactgtcaaaagggagattcccagctctagatggacgaatcaataatgatggcatgcattttggttaaaggcgagaaaatggacctgcgccagctacttggaaggattcaacataaaccgcaaaagaagggggcttttctgaatacttactcatgcagtgggtgtacataatcttttcaacttccatgctgacggcacttgtgcactcgtccagaatggcatagcgagggcggtggtagtaaagacgagccattgcaatctatggttgattgataggagaagatgtgacgcggtggcgaacatgaacgaggttagactcgacgtcaagtggctcatatcacgaacgtcagctctctcatacgagctacaaagccagtgttgcacctacacgttgcttgtctcctcctgaaagggcatcacgccactcgcgctcacggtcccaaccaccttcacgttcaacaatgttgttgagttggacaacctcgagaatctcttgaagatcctggtcggtgtagccgtttgctttcatttcctccacagtatcagggtagatgatctggtcgcggagggttccaagggagaggtagggtcgctgagggatgtaaaagatgttcttggggtgggggcgatggacagtaccgcctaaagaggtaagcgaaaacgatgagtgaggtcgggaaaccgcttgggcacagctgagctgttaaaaatgtgatgggcgacacgtcgacggaaaggatgcttaccatagacgggccagaggccacccaggatgcggaacaaactgctcttgccgcatccgttgggtccaacgatcaagagatgcataccgggcttgacatagaaactcagcttcttgagcaacacatcgccgttaggtgagacaatgggcacgtcgaggaattcgatggtatcatcctcgacgacatcgccacgaccagagaggaccttggcgttctcctctgtggaagcagaggagacaagtctcttctcaaagcgcccagccttgacatcctcaaagacatccagaagctcagagacacgagcggtatatccagccagctcggtgacctccttgtacgagtacatgatgcggccaaaggcatccgacgaactcaacaacatacgtctattggttacgaagcctagattgatttgtaaacgttattagagcctggtcgatatcaaaaaataaaaccaaccgactatgcaaaacaagggcgttggttaccttcagtacggccaccgatgtcagatccaccgctctgtccgggcaatttgaagaaaacagggatagagcagatgactagacccatagcaccccagaagtacttgatgataaagtcctcaagcataccatgccaaacacgcatgcggaagatacggttgacgtgcttgataagagcaaagtagttcttgtccaagatggccttttcgatatcgtgtccgccgaagagagcaatctcctccgcgttctcaatcacacgggaatgtgtgaagcggaactcgccctcgagacgctgctcctctgccaccatctttccgaaggggggtgtaagcgcgcgcaaaaccagagcagaggcgtgaagcagagcactcacaccgaaaagtccctctcctccgacactcttggagagctgcacgttgtaaataataacgtcaaggatgggtttagccaagttggagtagagttctgacagggacgtacagaacttgttcacgtccacggtgatacatctatcacattgcaaaagaagaaagaaagagaaaggcacgagccttcagtcagcaggcggtgcaatattcgacgcgatattcgatgaagcttaaaccctagcacatactgatcagcgttcttgatacggtcatccaagttgccgatggcgtagaacgtcatgtctgtgaggtactgttcgtggatgtggttggtgagacgtgtgcggaactggatggcgagcttgctctgcatgtatgtcaacatgctgttggtataggtggcgggcacagccacggtcatccaccagagcaatccgaccatgaagtcctttgcctggcctcggaccagcgcactaacgatcctgccgtcaagcgaagcgatgtagacggagagcattgttctaaagactgtgcgtaagcgcaatcgacgtatttggaaagcggttaattgctctgccgccgcaactaggtgtttttcctgtgatacacagcttcttcgcgacgtggggttgttgacacagcgtgaacatcccagtcgaccttagtcatccaatggccgtgtctctctgcgattctgtgcccgtctttactggtgcacccttgtcgatcaacctccccttcccaccttttgataacgacagtcatctatacatacctaagaatccactgtgaactaccagcaaccagaactccttggaacgccatccagggataaccaagcggagaatgcgcatgaaccgttcgaaaaaaacgcgatcaacctgcaggatggacgaaatagatcgcaagagggatgagggtgtggctcgtttgtcatggcttccaatcatcatagttggctctagtcagatatgatccttacagcaaccttggtgcttttgccatcacccttgacgagtcccgactttttagagtcggccttcttgggcttgtaggtggccatgccatggatacggaaagcgagggtagcgaggatggtgatccagatggagcgcttgaccttggaacggttgttggagtaggccttgacgaccttggcgaggacggccttgaaagctacggggtcaaagaccgccgaggctgtggcgggttttgaaaagattcccatggcaggaatgtgggaatgggatcaggcgaggcgaggtcaggatgaacgattggactggaggtgcggagcagggcaaacaagagcgtccttgctgcaagagagagagagagagagaaagagagagagagagagagagggtgggagagggtgtctgtgtgtggggggaaggtgcgtattcgggattgtcaatcaggaatatgccgactagatgggatccagctcgagtcgggccttcgttgctgtcttcctgtggagggtgcagggatggagcgtgccaagcggagcagcagtggaggtggaggtggagtggagtggacgaagacgaagaggagtgagagtgggagtgagagcgaggaagtagggttgcgatgagggggatgatgcaaagagggatcgcaccaggacgagcaagaagcgcaaagggaaagaaaaaaaaaaaaaaggagaggcacgacgaagcgccactgctgtctgaccccaagtctgtgtagctgtagcccgtggtggttccggcggtggcgatggctctcaccctcgcacacgcgcacaccctcaccctcgcaccctcaccctcgcacccacgcactcgcactctcatcctctcgctcccgctcacgttcaccgccttcctcgtgcctcgcgaccgtgtggagaaaacgcccggcggggtcttgctccactggctgctcaaactcagatcaggccaccaacgcccatccccctcattgctgaatccatcgttgcttccacagcactcacaccccggcctcctgcactcagcctgctgctcgtcgcatcctggcctacatcacgacactcttcccacctgtgctggtgcccaggtggtctctgttcagtatgtgataccttgatcggcgaggaagaagaaacttcgtgaactctctcacgtgtcagtcaacacgagtccgtggacttggttggaggggcaactcacacaagcgtcgcaccagctctgcgatctgactgcactctcccagggcacatcgagcatccagtcccattcacgattctcgtcaagagcaagctggagcttgatcagcggcaaggatcctccacttggatcttgctcggcactctgagcatccctcctcgaagaatgggtcttgcatgatatggaaaatctcgataataaggttttgccatgcgacttgatctggctcacacatgaaaaatgagatccaacactgactgctaaccctcagacgcgtccatcactggcattttaccctcaaatcgctcacacacacagagaaaaacgaagcaaaaggttcagtttaatccagctagaccagcctctcagatttgccagcatctacaacactcctaatgtcacgcagtagtgccttggcgtcttcttgatgctgctcagatgaacactgcatggcctccgacgcatagtcggaagccgcagccagattccctttctctcgctcatacaacgccaaaaagatgcacgcctcggacgtgtcctccgactcgtcctgtgcttcccgtagctgctccagactcttgcggaaatagtgagccgctgcttctgtgtccccgattctcttatacagttttggcagtttcttgagtgccatcttctcctgatcagagcccagtagtgctcttgtataacatttgatcgccgccaaatcctgatccaagtactcgtagcactcggccattgcgcaccaaatgcgcccatcatatggcctgattgcagtcgcccgctggtagtatcccagggcgtaataatgcatcttgagaacctcgtacgtctgtcccaacccattccatgcgcgatagtcccgatgattgtaatctacgtgtacaatcgtacaagcaactgcttagatacatcatcaagaacaactgcaaagctcaccattccatccagtgaccaagagacttacccactgctcgcctatatgcctccacagctgcatatgtgtttttcatttccagatattcgtgtccaaggagtgtccacgcagaggcataacttctgttgaatcgtaaggctcgcttgaagtagatgacggccttttcatgctcccctttcatgctgtagtagtttcctgaaaaatatgaacagttggcatttgattatctgtgatattgacactgtagtgcatggatattcatcagggtcgataaacagcgatatagtagcaaattcacatcctaacctatgatgcagcaagtctctggtctgtagttgtccgtcattgcgcagctgtgagccaagaagctcagcctggcacgactctcggtaacgaaaagtacgttggaataaacgtcgagactgtccaagcgatgcgggttctccttgatcaggtcttcaaagagcttggcagcctcagggaaatctgaatttgggcacgtagtgcaaaaatggtacatctgttaacggctgaagatatttggtcgccagtctcgcggcctccttttcatgctagatccacatcctcacctcttgcatgataaagcgctagagcgcgttcgcacttgacataggcactcttagggaatgcctccattaattcctcgagccacaaagcgccatcctcatgttggttattgaagtgctccagagttacatgagacagaaaataggtcgtcatgaagctgtccggcagctctggcttcattttcatgacctagagatgggtccagagttcaggttggcgccatttttgaaaagtgttaaccaggaagttgagctaagttgattgcgccaattcacaaaagtcgaacacctactgctgcatatgatgggaggcaggagcccaggtccagccaggcactccagttatacgggtattgattcacagattccaccaagaccttgaccgccaaacttttgcgttgtcgcttgatgaggactgttccgtatctacaacgcaggaataatacaggcgttagaagatacagttgtgaagtagtccacttcgaagttcgcgttttctcggatgcacaaagttcgcttacaggtatttacaaaaggagtcaagcgtgccagcattgtagcactctgtcagttcagaatcgatctcctggatctctctattgactgccatgccgttgtcaagcggacctattcattgttgccaactcgagtcagtaagctcgctgctgccgcgttgcaaaaataaagagcagaaaacgcaaaagccgtcataatcgtagcaggttcatcttacccagcacctcgcgcgtgtcctgttcccgccgcttctcccctacctggaaaacggatcaagcctcatacaaacgttaatacagtcctgtttgaacatcctgctgaaggtcgttaacacacacttacaaggtattttgagtagagcctcagaaaacgcgactttgagcttgtacatccagagaggacactggcgcagcgatcaaactcctttaggtcgaaaaaggtcttggccatcaagtaggtgtcgtgctctggcaaaggtacattagttggttctgaacacaggtcgagacagagctcctcggcatagggtgatgtgtatctctgtccatcggaaggttttgctgcttgagagcgcgttgtctgtaggtcgtactccggagttggaagaccattcagtgcctcagctgccctgtggtggtagtttgagaccgaggcatctggtcagcacaaaacgaggtgcaaagaggtgcaatggattcctgatgaaagttgaacgaggctgaatgtacgctcttccgttaccagcgtgcggcaaaataaaggccgcgctcattgcacgcttggatcgtctcgcgtaaagttcctcgtgcttcgtttggaggaagggaccaatggttggagggctgtgtggtcgtcatggtgggcgtgaggctggaagacgtatgcggccaactgggaatgtggaacgtgtgggtgagctccctgctgatgttggcgttcgatgttagggacaggaggttgaggttgaggtgagtgtaagtggtgatctttggaacagcgaagcgcgtttttgtatgaaatgcggtggcttttcagtgcgcgtggccctgcaggggctgcggaatacgaaaagggccttttttgtcatttgaatttcgttcctcttcacaacgagtcatcaaccctattctgctcctcttacaccaaccatgtccctggccaagcaaaacttctcctccgcttccgaggaggccatcaacactcaggtataatttgcgagcgcatgtcagtcaaattgcacgactgcacggtcgtttgagcctgtctctctgaatgagaaactaatgttcgtgtgcccaacgtcatgtacttcgttcatgggtgtctgccgacatgctcgccccacagattaaccaggagcttcaggccgcacatgtctacctctcgctctcgtcttgggccggtcacgtcaaccaggccttgcccggtttggaaaagttcttccgcgaaagtgccgaggaggagcgtgagcatgcccagaagctgatcaactaccagaaccgccgtgggggcaaggttatccttgagactctccaagccccagatcccgactggtcttctgctcgcaatgctatcgagtcgaccctccagctcgagaagggtaagatcaccattctcatcctttacatgcgacggagagcgtgggatcataaaagcagcctctcgctgtaaaagcgcacgatgcgaggccaaagattatggatatattaacttaccgctcgtaccatcccctagacgttaacaagagcttgctcaacctccacaaaattgccgaggaaaacaacgaccctcagctctgcgattttatcgagtccgagtacctcgaggagcaggtcgaggccatcaagaagattgccgacctcgtcacgcagctcaaccgtgtcggcggagacggactcggacgtaagtttcccaaagtgatcatgtttcgcttaatgagcatacacccctccgataccttgtgcgtgtgtcaacgggtgcgccattggaatgaggttattcaactgacgctcgttttcggggttccttttttgtattgatagtctacctctgggaccaggaacttttgaatgggaagaaggagtaaaatcctttacgcttaaattctacctcgttcaaaaccaaaaacgaaagaaatctgctttttccaaaatgagcagtcgctgcaccgtggcgaggcggagggcactgcgccgagacagagggagtggcagttggattcatcacgtccgaagaaataaattctagaaccgtctccatccatgctacaccggaaggggttgttacatcaattcgtttccaatgctttgccataccttgacgatcagccaggacgaggataaaagcgagacaatgggcggccccaaccactttacgcaaattcaggctcggcacactgagcaactcctactcgtgctcgggaaagtgtaccctttttcgaacagacgatagaagatactcagcaaacgtgagagcgttgtgtttccagaaaaattggcacatcgcacagaaaaatccttgcctgactcgtgcactttccggcgtatttaacttggtcaccacttctcgcgcctcttatgggctgatcagaccccggtttctgcaaacggtcttcaactagtgccagaatcgtgataatgcgatgcaacccgcatggttggcctctccagcgcgagggctttcgtcctagccggtcgaatcactcgtccgaccaaattcataaatcgacaagattcgccatgtccccatggtcaaaggctcctccccaaggcgaaagggtcgattccgctacttacttggtcaagttctccaatccgtatataaaccgcctcacgcactcttcacactctgaaacactgacacgaatgcatgtaacccgatcattctccaacattctcattagacaagtcgccatctgaagatcgggtcagctgacgctagatcgctatcaatgagggtgctggagtactctagggctcttgatgggtacgtggcaccctggttagcaacgtcaggcagcgccaggcactccatgcgacctgcgacgactctttggcgcgtcacacggtgtttctgcagctttttagttcagtgtcacagtccgaaaaccttaaactaatagataccagggaaccagcgcccatatatataccttcaatcagggtcggctctttcaaatggtcgtcgacagtgtgaaaacgattatattgcgattctagcggcatggttggcttcttgaaagcgagggcttccgtcgtagccgcttgataaacattatgatgaattataagagaggacctgaagtgaatagaatccaggaagaagccagcgccaatataccttccatctgtgtcggttcctacaaatagtcgtcgacagtgtaaaaacgattataatttgatgctaacggcattgctggtttctcgaaagcgagggctttcgtcctagccgcttgatatacattatgatgaattatttagggagaacctaaagtgaatagaatccaggaagaaaccagcgcgcatcaccattgatcaggacagattctgcaaatggtcgttgccgctgcaaaaacgattataattcgatgctgctggtatggttggcttctcccgaccgagcacttcgtcccacgcgcttgatattcatattgtcaaggattataagaaaaaacctgaagccaatagtatccagggtaccagcgcccatatatctttgatcagcgctggttcttgcaaacggtcgttgccggtgcaataacaattataattcaatgctgctggtacggctggtttctcccgagcgagtgctttcttccacgcgcttaatattcacattgtaaaagtttccgtgaatttggtcctattcgcaccctttcaccgactttctgcctttgaggagcagctcgattccgcaagtcagatggtcacgatgagcaattgctgagaacattgcctcacaatgttcagagcactctcaaaggtcgggaaaagcggctgcaacgatcaggcgccaagtaccacattagcccaccctcgcctccgaaagcagcgcacagcggtttttagtgtataggtgtatggtagagagctgcgagaggctctagagcctttaatggctacctggcgccctagacagccgcaccagcggtccgcgatgactctctggcgtgttatacagtcggcacggtggttttgcagcgaattactgaacaggcagagcgcgtaaacctaaaaaatcgagttcaggcacaggcacttttctactaggacttgactatgagccctagcaccttcatatggccatatagaccatacatatgtcccatccggcgcatctcattggccgatcaggcgcggtgcttgcacatggtcgccgacagaatataatcgtgtataatccgatgtataatccattatattgcgacgccaccggcacgcctggcctctccggagcgtgcgcattcaaactagccacttgaatccaaaatataataggtttcttgaattcgcagcattcgaactcgtgaatcgaccttttctccttgatgaggaggtcgattccgcaactcagatggtctagatgagcatgctgaaaacagtacctcacgcgaatcagcgcactctcaaatctcaggaaaagtggttggagcgagcaggcgtcgaaaagtgcattagcagactcaagcgcgaaagttgtgcacaggggtttcactcaagggctcttcggctcggatgggctacctggggccttggatagcagttcaaacgatccacgatgactctctggcgcgcaatacaggcagcgcggtaatcctgcatcggttcatttcacggagagagcgcgaaaacctataaaatcgatctcaggcaaccattcatatggcctacatcacccataccacagcccacatccgctaattctactagatcagcgcgagaattggaacttttttttttgaattgtttttggtggcaaatcacgagcggactgctcttgtgtagcactatggtgcctcgagcctttgttcattgcttttgtttctgcattctctcgtctcccttgcagcacccatcccgaacaacacgcacgggtcgcgaagatctatagtttgttgttggcgtctgatccctccagtcctgaacagcccccttcacatttagtgcccagctcgctttaggtaagtgtctcacggcatggcaaagctaggatggtaatgctgctgaggcgacacctgtttcaagctccctggaggacttgaatggttttgctacataagcctcgactggatccatcctggacgcatgtagcattcgacgtttcttggttcaaagtttagtcaagcttacacttaccactggctcagaccccttctgccttcttcattgtacaccttcaaggtcacttgccccatgccacctaagcgcaaagtaaccagcgacacaacagaggaagcgcccgccaaggtcgccagggccacgcggaagagctctactaccaaagccgcgtcgaaaacgaaggccagccatacgcccggctctagggtagggacagaggaggagcttgaggtatgtcatacagccggcgcgatcctcgatccacacatacgccctatcagcatcaccatggccgaaatttcttgttatggtggagacggcacaaaagaggggggggggggaagtgtctgccaccacgaaaataagaacagcctttttttttctgcctccttccttgttcacctttccgtttttttgtctcctttggtccaccctctccacacaccgtcacctctggcgcagcagcggacacaggacaacaccgcagacctacacccgggagacttcacctgcattcaaaaagtaccctagtcacggcaggattcagtcaaccatgggcaacaaacacagcacgaataaagacattggcaacaaatcaagaggagcaaaggtcgacacgaattccagagcctcattcctttcatcgtaagggtcatctcctcgcactaatgcacacgcttcacagcgctagcatagtcaacttggcacagctcaagcagactagtcaacttacaccttgtctgaccttggcacgttttcgcccaggcccaagagtagtgacctagagtctcgtgtgcttaacagcaaattggggtccaagccagcatccataccgaccacgcccactgcttctagcacaaacgcgactacgaccacacctacagcactgccaccaaaagtatgtctgtcagcctcggacgtcctctacccatcccatatcgtccatcaccccaccttctcccacctgatacgctgttgccaaccacaccctaacctccgaatcaactttaacttcatatagaaaccattcgactctaggaaatgcctggcatggttcaagacttacacaggtattgatcaatgccgttattatcagccgtgatgactgagttacgttgcgaggtctgaaataaccctcacttctcattatccattttccttatattaggccttgaagaagaggaagaaccagatgcggatcaaataggtcccggtggaattactaaactttgcgaggatatcaacgtttccttggatgcggtacgccattctataaccacattgatgcttggccgagggctgttgtgaggcgttgggcgatgctctcatcaaaaatggaaggactggtggggtgctctgagctgttaattaacccatcccgtccctgtaaataggtcgatatgcttgtcctggcttaccacttgcaggctgatacgatgcgtgagtggaacgcttgccttttgcagttttggattcacagatgtgtcgctcaaaaagccgatgtaccagttctaacccaattctttctgttcttcaatatcacatagcaatcttcacgaaggaagagtggatcaaaggaatgacaaagttggggtgcgtgggatagtatgctgagacttggtcgtggcggttgaacggtcgctgaaaaagaagtacatcactccttgctaattatacccgctcataatcatccttataatccttagaatcgattcaactgagaaactgagggttaaaatgcctagcctggtcggtgcactacaagatcccaagcatttcaaggaattttatcgatatgtttttatgtttgcaaaggactcggagcaaaaatgcatgccattggaggtacgtatctggccttcatattttgtatatgtagtcagcaactacttgatttgtctaacagatctcatacacacattgaatgcatttagacggcttgcgctatgcttggtactgtcatgaaaggaaggccacatgaaaaacgctttgttgcctacttggaggtaaaaatattctaaaacttgcagtcggagtggatgactactgtgatgggcgtgtctgatatagcatatatttcgtttcctaggcaaaacgccctgtcaaagtcatcaacaaggaccagtggtataatttcctggacttttcagactcgatcgccgaagacctttcaaattacgacccaatcggttctgcttgtaagttgcgacacgacctgacgcagcgaactaaaacccttgcgacggtcgttgaagacattgaccaattgtatttttgctcgtcaaccttgttttttagggcccgttctcatggacgagtacgtcgagtggcggaatgaggaaactttgtaaacgcaggaaatgtttgcgcaaggaccgaagttgagctgttaattcgcaaaccaaataaacgcccatcctactgagtgtacagtacatgtaatgcgcaggcggggactttgggtatctgacgatgtctgtgatctggatatacatgcttctcacggcatgaggtaaaatgacatgcaggctgtggcaaacaactacagtaccgctgttattccttcggaaaaagcgttaacgactcctccacatcaacattcttaacacaagtttgcgtttacgctctttttttttttttttttttttttttttttgtgcaatcatgattgcttctacacgagtaatttaaaagcgcgctttattttctgtacatggtcttttatgcgtgttctcttttacagggcgatctgggaggaacgccggccaattcgagcctcgagaagctgggccatggtcacttgtcttgctgggcggatttagcaggccttggtggcagtaacggtggcagactggcagaacagaatgtggttgtttccgttcgtagcctggacggtcaactggacggggatctaatcacgggcaaagaatgcacagaaataggacagcatcgatgatgtgttagcgatagtggggatgtgtcatcactgccattcgggtccagcaggtaatggcgcgtcagacggtgaacggggaagaaaaagtacttacgttggcgggggcagtggacttgactggcacgcaagcagtgatggaagtcaaggtggtggggatggggcatgggtgaccctgagcagccatgagagtgcacaagtcatggttatcctggtaaacgacacgtccgaggtacttgccgacgatggacagcttggcgccggcaatgacgggggtgctcaagacaccagttccagtggcgcagacctcctttccgacgcagagagggtaaggggagatcgagaaggtgtcaatgacgatgtcagtaggtccggtcgcgcagttggtgaagggaacctgggcgttggcaacggtggcaacgaagagagcggcgatggcggtgatgaacttcatgttggaatggttggcttgcgtgggattgcttgtgctgaggagagggaactgcttgagggtgaggaggtaaaagaagaaagcgagacacggcgagaatgggcgccttttatacgcgtcaagagctgatgtaagctagtgaccctggccgatatgcgagcagacttgccatagaagcccgctctggcgctttgtacagtagggcagacatgaggcctattgtgtaggggatactttgagtagccgtaagaattttttattttgttgagtagacgatgtgttcaagagatagaaattttcatggctgctgatgatctgctatgggctaccgaccaaagtgtgcagactaatctatgtcgttcaaaatccgcgagatatgtggagcagcggaatatcctcccgtctaagtctgtggagtgcaaacctatttcggcggcaaaatttgaattgactgaatgaacgtctgcaacggtgggaaaccgcattcaacctgaaggtattttgtcttattttaaagtgaatagcagcaaaacaaagcaaaatctttttttacagtagaagcgctggtacggcgccatgcatgacaggcgctctcattccctctgtctctttcttgtactcgcaacgaggcttctgaattggccttctctgtagcatactagctcctcttgtacgaaaatgaccccgatcgatttccctcaatcaactggcggagaaaagaccaacgccgcctgttcctcaggcgtgcaaaacactgttatcacatagacgaagaacagttctgtacagaaatggccatagttgttgggttggtagtatgaagagtacgagggaggggacagagtcaggggtgagtccatcatcaacacgataatcctaacacaaggcacaaaactgtttatattttaatgcattgcaggaattaaaaccattgcactgtacacaagaacatcaggccatcgaggtaatgcgcacaaacacacatgttagcttgcctgcgagaccatgcttgggttgaggaaagaggaaagagaagcgcgacgattgagcccatcacagagcaggtacaggggtatcgatgaagaaggcgagagtgattgaatgatgccatggggcccgatagcctcccgtcctctgcacattctgttttgtcatgatttacccaaccccacacactgatggaggtcgaagtcgggattcgcatgactataggccacattccaataatggaggaaagagtcaactggtgaacaccccttgacctagaggcagcgattgagatgttgatggccactgtgcgccacaggaacagtcggtttgtaggcccctgttctccagaatcggcggctgttcatgaccaaaaacatgccttacaacgcaaggttatcactttgatcctcatgaacctctatagcgcatccgtgtcatcgcgcacccgtcagtggatattccgcacaggtcttgtactttacaatgactcaacgatgcgcatcaagtacgtacttcccccattgagtacaatggttcttcctgcacagtgagaaaccatgctggaccgttggatcgatagaggaaaataacagcgcattgcattgcatggccaattgcaggttcaactaccacagagaatttgtgtgcacaaagtagtcgatccactgaataccccggtcggtgtggtcccactgccccttctttgtctgcgcaggcaagccaaatcttcctcacaattgggtcgctgtcgtactcttcaccattattatcgcaacacaaaggcgggatggtagtgccaataagcgctgatcgttcgtctcccttgcccttctgtccaacatacatccgcaaccaccagcataacgatgagtgatcgatagtatcttc
